US008318154B2

(12) United States Patent
Frost et al.

(10) Patent No.: US 8,318,154 B2
(45) Date of Patent: Nov. 27, 2012

(54) SUPER FAST-ACTING INSULIN COMPOSITIONS

(75) Inventors: Gregory I. Frost, Del Mar, CA (US);
Igor Bilinsky, San Diego, CA (US);
Daniel Vaughn, Encinitas, CA (US);
Barry Sugarman, San Diego, CA (US)

(73) Assignee: Halozyme, Inc., San Diego, CA (US)

( * ) Notice: Subject to any disclaimer, the term of this patent is extended or adjusted under 35 U.S.C. 154(b) by 379 days.

(21) Appl. No.: 12/387,225

(22) Filed: Apr. 28, 2009

(65) Prior Publication Data

US 2009/0304665 A1 Dec. 10, 2009

Related U.S. Application Data

(60) Provisional application No. 61/125,835, filed on Apr. 28, 2008, provisional application No. 61/127,044, filed on May 9, 2008.

(51) Int. Cl.
*A61K 38/00* (2006.01)
*A61K 38/46* (2006.01)
*A61K 38/47* (2006.01)
*A61K 38/28* (2006.01)
*C07K 14/62* (2006.01)

(52) U.S. Cl. .................. 424/94.5; 424/94.6; 424/94.61; 424/94.62; 514/5.9

(58) Field of Classification Search .................. None
See application file for complete search history.

(56) References Cited

U.S. PATENT DOCUMENTS

| | | | | |
|---|---|---|---|---|
| 3,837,339 A * | 9/1974 | Aisenberg et al. | ............ | 604/504 |
| 4,002,531 A | 1/1977 | Royer | ............ | 435/188 |
| 4,179,337 A | 12/1979 | Davis et al. | ............ | 435/181 |
| 4,373,527 A | 2/1983 | Fischell | ............ | 604/891.1 |
| 4,562,751 A | 1/1986 | Nason et al. | ............ | 74/111 |
| 4,573,994 A | 3/1986 | Fischell et al. | ............ | 604/891.1 |
| 4,685,903 A | 8/1987 | Cable et al. | ............ | 604/154 |
| 4,894,443 A | 1/1990 | Greenfield et al. | ............ | 424/179.1 |
| 4,952,496 A | 8/1990 | Studier et al. | ............ | 435/91.41 |
| 4,973,318 A | 11/1990 | Holm et al. | ............ | 604/208 |
| 5,052,558 A | 10/1991 | Carter | ............ | 206/439 |
| 5,122,614 A | 6/1992 | Zalipsky | ............ | 548/520 |
| 5,183,550 A | 2/1993 | Mattiessen | ............ | 204/415 |
| 5,279,543 A | 1/1994 | Glikfeld et al. | ............ | 604/20 |
| 5,323,907 A | 6/1994 | Kalvelage | ............ | 206/531 |
| 5,324,844 A | 6/1994 | Zalipsky | ............ | 548/520 |
| 5,433,197 A | 7/1995 | Stark | ............ | 600/319 |
| 5,446,090 A | 8/1995 | Harris | ............ | 525/54.1 |
| 5,462,535 A | 10/1995 | Bonnichsen | ............ | 604/272 |
| 5,497,772 A | 3/1996 | Schulman | ............ | 600/347 |
| 5,514,646 A | 5/1996 | Chance et al. | ............ | 514/3 |
| 5,569,186 A | 10/1996 | Lord et al. | ............ | 604/67 |
| 5,586,553 A | 12/1996 | Halili et al. | ............ | 600/316 |
| 5,599,323 A | 2/1997 | Bonnichsen et al. | ............ | 604/272 |
| 5,612,460 A | 3/1997 | Zalipsky | ............ | 530/391.9 |
| 5,618,913 A | 4/1997 | Brange et al. | ............ | 530/303 |
| 5,626,566 A | 5/1997 | Petersen et al. | ............ | 604/208 |
| 5,643,575 A | 7/1997 | Martinez et al. | ............ | 424/194.1 |
| 5,660,163 A | 8/1997 | Schulman et al. | ............ | 600/345 |
| 5,665,069 A | 9/1997 | Cumer et al. | ............ | 604/116 |
| 5,672,662 A | 9/1997 | Harris et al. | ............ | 525/408 |
| 5,721,348 A | 2/1998 | Primakoff et al. | ............ | 536/22.1 |
| 5,747,027 A | 5/1998 | Stern et al. | ............ | 424/94.62 |
| 5,766,581 A | 6/1998 | Bartley et al. | ............ | 424/85.1 |
| 5,783,556 A * | 7/1998 | Clark et al. | ............ | 514/6.6 |
| 5,791,344 A | 8/1998 | Schulman et al. | ............ | 600/347 |
| 5,795,569 A | 8/1998 | Bartley et al. | ............ | 424/85.1 |
| 5,808,096 A | 9/1998 | Zalipsky | ............ | 548/520 |
| 5,827,721 A | 10/1998 | Stern et al. | ............ | 435/201 |
| 5,854,046 A | 12/1998 | Au-Young et al. | ............ | 435/201 |
| 5,866,538 A | 2/1999 | Norup et al. | ............ | 514/3 |
| 5,900,461 A | 5/1999 | Harris | ............ | 525/54.11 |
| 5,919,455 A | 7/1999 | Greenwald et al. | ............ | 424/178.1 |
| 5,932,462 A | 8/1999 | Harris et al. | ............ | 435/188 |
| 5,945,676 A | 8/1999 | Khalil et al. | ............ | 250/339.12 |
| 5,947,394 A | 9/1999 | Egan et al. | ............ | 241/30 |
| 5,954,643 A | 9/1999 | VanAntwerp et al. | ............ | 600/316 |
| 5,958,750 A | 9/1999 | Au-Young et al. | ............ | 435/201 |
| 5,984,906 A | 11/1999 | Bonnichsen et al. | ............ | 604/272 |
| 5,985,263 A | 11/1999 | Lee et al. | ............ | 424/85.2 |
| 5,990,237 A | 11/1999 | Bentley et al. | ............ | 525/54.2 |
| 6,011,984 A | 1/2000 | Van Antwerp et al. | ............ | 600/317 |
| 6,034,054 A | 3/2000 | DeFelippis | ............ | 514/3 |
| 6,054,569 A | 4/2000 | Bennett et al. | ............ | 536/23.2 |
| 6,057,110 A | 5/2000 | Au-Young et al. | ............ | 435/6 |

(Continued)

FOREIGN PATENT DOCUMENTS

CA 1243948 11/1988

(Continued)

OTHER PUBLICATIONS

Jars et al. Insulin Aspart (AspB28 Human Insulin) Derivatives Formed in Pharmaceutical Solutions. Pharmaceutical Research, Vo. 19, No. 5, May 2002.*
Aragona et al., "Intensive insulin treatment and postprandial control in Type 1 diabetes," Acta Biomed. 76(Suppl 3):26-30 (2005).
Ciaraldi et al., "Effects of the rapid-acting insulin analog glulisine on cultured human skeletal muscle cells: comparisons with insulin and insulin-like growth factor I," J. Clin. Endo. Metab. 90:5551-5558 (2005).
Raskin et al. "Use of insulin aspart, a fast-acting insulin analog, as the mealtime insulin in the management of patients with type 1 diabetes," Diabetes Care, 23:583-588 (2000).
Letter/Written Disclosure of the Information Disclosure Statement for the above referenced application, mailed on Aug. 9, 2011 (2 pages).
Response of Feb. 26, 2010, to the Written Opinion, issued Nov. 11, 2009, in connection with corresponding International Application No. PCT/US2009/002625, 21 pages.
Response of Oct. 5, 2010 to Opposition, issued Apr. 5, 2010, in connection with corresponding Peruvian Application No. 574-2009, 33 pages [p. 1 in Spanish, followed by English instructions].

(Continued)

*Primary Examiner* — Marcela M Cordero Garcia
(74) *Attorney, Agent, or Firm* — McKenna Long & Aldridge LLP; Stephanie Seidman

(57) ABSTRACT

Provided are combinations, compositions and kits containing an fast-acting insulin composition and a hyaluronan degrading enzyme composition formulated for parenteral administration. Such products can be used in methods of treating insulin-treatable diseases or conditions. Also provided are methods for administration of a fast-acting insulin and a hyaluronan degrading enzyme.

81 Claims, 2 Drawing Sheets

U.S. PATENT DOCUMENTS

| | | | |
|---|---|---|---|
| 6,074,372 A | 6/2000 | Hansen | 604/211 |
| 6,110,149 A | 8/2000 | Klitgaard et al. | 604/209 |
| 6,113,906 A | 9/2000 | Greenwald et al. | 424/194.1 |
| 6,123,938 A | 9/2000 | Stern et al. | 424/94.62 |
| 6,193,963 B1 | 2/2001 | Stern et al. | 424/94.6 |
| 6,214,966 B1 | 4/2001 | Harris | 528/322 |
| 6,221,633 B1 | 4/2001 | Ertl et al. | 435/69.4 |
| 6,258,351 B1 | 7/2001 | Harris | 424/78.3 |
| 6,302,869 B1 | 10/2001 | Klitgaard | 604/218 |
| 6,340,742 B1 | 1/2002 | Burg et al. | 530/351 |
| 6,379,339 B1 | 4/2002 | Klitgaard | 604/207 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,495,659 B2 | 12/2002 | Bentley et al. | 528/425 |
| 6,524,280 B2 | 2/2003 | Hansen et al. | 604/207 |
| 6,551,992 B1 | 4/2003 | DeFelippis | 514/3 |
| 6,552,170 B1 | 4/2003 | Thompson et al. | 530/351 |
| 6,554,798 B1 | 4/2003 | Mann et al. | 604/131 |
| 6,558,345 B1 | 5/2003 | Houben et al. | 604/66 |
| 6,558,351 B1 | 5/2003 | Steil et al. | 604/131 |
| 6,582,404 B1 | 6/2003 | Klitgaard et al. | 604/181 |
| 6,589,229 B1 | 7/2003 | Connelly et al. | 604/890.1 |
| 6,641,533 B2 | 11/2003 | Causey, III et al. | 600/300 |
| 6,669,663 B1 | 12/2003 | Thompson | 604/67 |
| 6,737,505 B2 | 5/2004 | Bentley et al. | 528/425 |
| 6,740,042 B1 | 5/2004 | Lerner et al. | 600/543 |
| 6,740,072 B2 | 5/2004 | Starkweather et al. | 604/504 |
| 6,744,350 B2 | 6/2004 | Blomquist | 340/309.16 |
| 6,828,401 B2 | 12/2004 | Nho et al. | 526/333 |
| 6,828,431 B1 | 12/2004 | Frudakis et al. | 536/23.1 |
| 6,852,104 B2 | 2/2005 | Blomquist | 604/504 |
| 6,858,736 B2 | 2/2005 | Nho et al. | 546/290 |
| 6,872,200 B2 | 3/2005 | Mann et al. | 604/890.1 |
| 6,895,265 B2 | 5/2005 | Silver | 600/345 |
| 6,906,028 B2 | 6/2005 | DeFelippis | 514/3 |
| 6,936,029 B2 | 8/2005 | Mann et al. | 604/131 |
| 6,979,326 B2 | 12/2005 | Mann et al. | 604/890.1 |
| 6,999,854 B2 | 2/2006 | Roth | 700/282 |
| 7,105,330 B2 | 9/2006 | Stern et al. | 435/200 |
| 7,109,878 B2 | 9/2006 | Mann et al. | 340/654 |
| 7,148,201 B2 | 12/2006 | Stern et al. | 514/44 R |
| 7,241,278 B2 | 7/2007 | Moller | 604/211 |
| 7,267,665 B2 | 9/2007 | Steil et al. | 604/131 |
| 7,279,457 B2 | 10/2007 | Pohl et al. | 514/3 |
| 7,317,000 B2 | 1/2008 | Hoeg-Jensen et al. | 514/3 |
| 7,354,420 B2 | 4/2008 | Steil et al. | 604/131 |
| 7,368,108 B2 | 5/2008 | DeFrees et al. | 424/94.5 |
| 7,544,499 B2 | 6/2009 | Frost et al. | 435/200 |
| 7,713,929 B2 * | 5/2010 | Steiner et al. | 514/5.9 |
| 7,718,428 B2 | 5/2010 | Frost et al. | 435/375 |
| 7,763,582 B2 * | 7/2010 | Lin et al. | 514/6.5 |
| 7,767,429 B2 | 8/2010 | Bookbinder et al. | 435/201 |
| 7,781,397 B2 | 8/2010 | Stern et al. | 424/94.62 |
| 7,829,081 B2 | 11/2010 | Bookbinder et al. | 424/94.62 |
| 7,846,431 B2 | 12/2010 | Bookbinder et al. | 424/94.62 |
| 7,871,607 B2 | 1/2011 | Bookbinder et al. | 424/94.62 |
| 8,105,586 B2 | 1/2012 | Bookbinder et al. | 424/94.3 |
| 8,119,593 B2 | 2/2012 | Richardson et al. | 514/5.9 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 525/54.11 |
| 2003/0170243 A1 | 9/2003 | Stern et al. | 424/146.1 |
| 2003/0212021 A1 | 11/2003 | Frost et al. | 514/44 R |
| 2003/0220447 A1 | 11/2003 | Harris | 525/54.1 |
| 2004/0013637 A1 | 1/2004 | Bentley et al. | 424/78.17 |
| 2004/0158232 A1 | 8/2004 | Schetky et al. | 604/890.1 |
| 2004/0235734 A1 | 11/2004 | Bossard et al. | 514/12 |
| 2004/0268425 A1 * | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.61 |
| 2005/0287134 A1 | 12/2005 | Klein | 424/94.61 |
| 2006/0104968 A1 | 5/2006 | Bookbinder et al. | 424/94.61 |
| 2006/0247201 A1 | 11/2006 | Frost et al. | 514/44 R |
| 2007/0134228 A1 | 6/2007 | Stern et al. | 424/94.61 |
| 2007/0148156 A1 | 6/2007 | Frost et al. | 424/94.61 |
| 2007/0243567 A1 | 10/2007 | Chang | 435/14 |
| 2009/0123367 A1 | 5/2009 | Bookbinder et al. | 424/1.49 |
| 2009/0181013 A1 | 7/2009 | Bookbinder et al. | 424/130.1 |
| 2009/0181032 A1 | 7/2009 | Bookbinder et al. | 424/141.1 |
| 2009/0214505 A1 | 8/2009 | Bookbinder et al. | 424/94.1 |
| 2009/0253175 A1 | 10/2009 | Bookbinder et al. | 435/69.1 |
| 2009/0304665 A1 | 12/2009 | Frost et al. | 424/94.5 |
| 2009/0311237 A1 | 12/2009 | Frost | 424/94.62 |
| 2010/0003237 A1 | 1/2010 | Keller et al. | 424/94.62 |
| 2010/0003238 A1 | 1/2010 | Frost et al. | 424/94.62 |
| 2010/0074885 A1 | 3/2010 | Schiff et al. | 424/130.1 |
| 2010/0143457 A1 | 6/2010 | Wei et al. | 424/450 |
| 2010/0172892 A1 | 7/2010 | Uvarkina et al. | 424/94.62 |
| 2010/0184845 A1 | 7/2010 | Frost et al. | 514/44 R |
| 2010/0196423 A1 | 8/2010 | Bookbinder et al. | 424/247.1 |
| 2010/0211015 A1 | 8/2010 | Bookbinder et al. | 604/187 |
| 2011/0008309 A1 | 1/2011 | Bookbinder et al. | 424/94.3 |
| 2011/0053247 A1 | 3/2011 | Baker et al. | 435/201 |
| 2011/0152359 A1 | 6/2011 | Bookbinder et al. | 435/200 |
| 2012/0020951 A1 | 1/2012 | Shepard et al. | 424/130.1 |

FOREIGN PATENT DOCUMENTS

| | | |
|---|---|---|
| EP | 0822199 | 2/1998 |
| EP | 1048264 | 2/2000 |
| EP | 01064951 | 8/2007 |
| JP | 6-503721 | 4/1994 |
| WO | WO 92/10569 | 6/1992 |
| WO | WO 94/28024 | 12/1994 |
| WO | WO 96/06641 | 3/1996 |
| WO | WO 99/29230 | 6/1999 |
| WO | WO 00/02017 | 1/2000 |
| WO | WO 01/76640 | 10/2001 |
| WO | WO 01/87925 | 11/2001 |
| WO | WO 02/49673 | 6/2002 |
| WO | WO 03/047426 | 6/2003 |
| WO | WO 2004/078140 | 9/2004 |
| WO | WO 2006/091871 | 8/2006 |
| WO | WO 2008/016729 | 2/2008 |
| WO | WO 2009/047766 | 4/2009 |
| WO | WO 2009/111066 | 9/2009 |
| WO | WO 2009/111083 | 9/2009 |
| WO | WO 2009/117085 | 9/2009 |
| WO | WO 2009/128917 | 10/2009 |
| WO | WO 2009/128918 | 10/2009 |
| WO | WO 2009/134380 | 11/2009 |
| WO | WO 2010/077297 | 7/2010 |

OTHER PUBLICATIONS

Response of Mar. 7, 2011 to International Preliminary Report on Patentability for International Application No. PCT/US09/002625, in connection with corresponding European Application No. 19739183.3, 25 pages.

Examination Report.issued Mar. 29, 2011, in connection with corresponding New Zealand Application No. 588748, 3 pages.

News Release [on-line], Halozyme Therapeutics Inc., "Fourth quarter and full year 2010 conference call transcript,"presented on Mar. 11, 2011, [retrieved on Apr. 7, 2011] [retrieved from the Internet:<URL:phx.corporate-ir.net/External.File?item=UGFyZW50SUQ 9NDE5MjUyfENoaWxkSUQ9NDMyNDcwfFR5cGU9MQ==&t=1] [18 pages].

Bookbinder et al., "Evaluation of the compatibility and pharmacokinetics of co-formulated biologics with recombinant human hyaluronidase: Dose Response," American Association of Pharmaceutical Scientists Conference, Nov. 2006, Abstract, 2 pages.

Pinkstaff et al., "Evaluation of the compatibility and pharmacokinetics of co-formulated biologics with recombinant human hyaluronidase: Dose Response," American Association of Pharmaceutical Scientists Conference, Nov. 2006, Poster, 1 page.

Buse et al [on-line], "Comparison of human hyaluronidase + recombinant human insulin (RHI) vs. insulin lispro in a basal-bolus regimen in patients with type 1 diabetes (T1DM)," presented on Jun. 25, 2011, [retrieved on Jun. 22, 2011] [retrieved from the Internet<URL:aievolution.com/ada1101/index.cfm?do=abs. viewAbs&abs=10068] [2 pages].

Garg et al., "Comparison of Hyaluronidase+ Human Regular Insulin vs. Insulin Lisproin a Basal-Bolus Regimen in Patients with Type I Diabetes" Diabetes Technology Meeting, Bethesda, MD, Nov. 2010, Poster, 1 page.

Halozyme Therapeutics, J.P. Morgan 29th Annual Healthcare Conference Presentation, Jan. 12, 2011, 35 pages.

Halozyme Therapeutics, "Matrix therapies for life" Presented at Canaccord Cardiovascular, Diabetes & Obesity Conference, Dec. 8, 2010, 38 pages.

Kang et al., "Chronic treatment with PEGylated human recombinant PH20 hyaluronidase (PEGPH20) reverses diet-induced insulin resistance (IR) in mice," American Diabetes Association May 2011, Abstract, 1 page.

Kang et al., "Chronic treatment with PEGylated human recombinant PH20 hyaluronidase (PEGPH20) reverses diet-induced insulin resistance (IR) in mice," American Diabetes Association May 2011, Oral presentation, 21 pages.

Morrow et al., "Addition of human hyaluronidase to rapid analog insulin reduces the absolute variability of early insulin absorption across infusion set life," American Diabetes Association Scientific Sessions Jun. 26, 2011 in San Diego, CA, 2 pages.

Muchmore et al., "Recombinant human hyaluronidase (rHuPH20) accelerates rapid insulin analog pharmacokinetics (PK) when delivered either by subcutaneous injection or by continuous subcutaneous insulin infusion (CSII)," Presented at AACE Apr. 14, 2011, Oral presentation, 27 pages.

Muchmore et al., [on-line], "Human hyaluronidase coinjection consistently accelerates prandial insulin pharmacokinetics (PK) and glucodynamics (GD) across studies and populations," presented at American Diabetes Association Scientific Sessions Jun. 25, 2011, [retrieved on Jun. 22, 2011] [retrieved from the Internet:<URL:halozyme.com/ADA%202011Consistency%20Poster%20v2.1.pdf] [2 pages].

Muchmore et al., "Improved consistency of pharmacokinetic (PK) and glucodynamic (GD) responses using recombinant human hyaluronidase (rHuPH20) pretreatment with continuous subcutaneous insulin infusion (CSII) in type 1 diabetes (T1DM)," Diabetes Technology Society Meeting Oct. 27-29, 2011, San Francisco, CA, 1 page.

Beasley, D., [on-line], "Halozyme keeps options open for ultrafast insulin," published Jun. 26, 2011, [retrieved on Aug. 2, 2011] [retrieved from the Internet<URL:reuters.com/article/2011/06/26/us-diabetes-halozyme-idUSTRE75P1YM20110626] [1 page].

News Release [on-line], Halozyme Therapeutics Inc., "Halozyme's ultrafast insulin generates faster-in and faster-out profile for type 1 diabetes patients using insulin pumps," published Jun. 26, 2011, [retrieved on Jul. 25, 2011] [retrieved from the Internet:<URL:phx.corporate-ir.net/phoenix.zhtml?c=175436&p=irol-newsArticle&ID=1579735&highlight=] [3 pages].

News Release [on-line], Halozyme Therapeutics Inc., "First quarter 2011 financial results conference call transcript," published May 6, 2011, [retrieved on Jul. 25, 2011] [retrieved from the Internet<URL:phx.corporate-ir.net/External.File?item=UGFyZW50SUQ9NDI5MDMwfENoaWxkSUQ9NDQ2MjI4fFR5c GU9MQ==&t=1] [12 pages].

Frost, G., Investor Presentation Jefferies 2011 Global Healthcare Conference, Jun. 9, 2011, New York, NY, 22 pages.

Adams et al., "The c-myc oncogene driven by immunoglobulin enhancers induces lymphoid malignancy in transgenic mice," Nature 318:533-538 (1985).

Afify et al., "Purification and characterization of human serum hyaluronidases," Arch. Biochem. Biophys. 305:434-441 (1993).

Akhtar, M. and V. Bhakuni, "Streptococcus pneumoniae hyaluronate lyase: an overview," Current Science. 86:285-295 (2004).

Alexander et al., "The use of hyaluronidase with insulin in insulin coma therapy," Psychiatr Q. 30(1):89-95 (1956).

Alexander et al., "Expression of the c-myc oncogene under control of an immunoglobulin enhancer in E mu-myc transgenic mice," Mol. Cell Biol. 7:1436-1444 (1987).

Altschul, S., "Basic local alignment search tool," J Molec Biol 215(3):403-410 (1990).

Ansel, H., Introduction to Pharmaceutical Dosage Forms, Fourth Edition, Lea & Febiger:Philadelphia, p. 126 (1985).

Arming et al., "In vitro mutagenesis of PH-20 hyaluronidase from human sperm," Eur J Biochem 247(3):810-814 (1997).

Atkinson, M. and E. Leiter, "The NOD mouse model of type 1 diabetes: as good as it gets?" Nature Med. 5:601-604 (1999).

Batra et al., "Insertion of constant region domains of human IgG1 into CD4-PE40 increases its plasma half-life," Molecular Immunol. 30:379-386 (1993).

Becker, R. and A. Frick, "Clinical pharmacokinetics and pharmacodynamics of insulin glulisine," Clinical Pharmacokinetics 47(1):7-20 (2008).

Bee et al., "Recombinant human PH20 is well tolerated at higher intravenous and subcutaneous doses in cynomolgus monkeys," EUFEPS 2008, Munich, Germany, 3 pages.

Benhar et al., "Pseudomonas exotoxin A mutants. Replacement of surface-exposed residues in domain III with cysteine residues that can be modified with polyethylene glycol in a site-specific manner," J. Biol. Chem. 269:13398-14404 (1994).

Bergenstal et al., "Adjust to target in type 2 diabetes: comparison of a simple algorithm with carbohydrate counting for adjustment of mealtime insulin glulisine," Diabetes Care 31:1305-1310 (2008).

Bernoist, C. and P. Chambon, "In vivo sequence requirements of the SV40 early promotor region," Nature 290:304-310 (1981).

Bianchi et al., "Synthetic depsipeptide substrates for the assay of human hepatitis C virus protease," Anal. Biochem. 237: 239-244 (1996).

Biodel Diabetes Technology Meeting.ppt, Pfutzner et al., "Mealtime glycemic control comparing VIAject™ to Lispro," found at: http://files.shareholder.com/downloads/BIOD/488728673x0x156690/7FF7195B-F7D0-427F-AA08-A5673FB8CCF7/Biodel-DiabetesTechnologyMeeting.pdf, 33 pages (2007).

BioWorld Today, "Clinic Roundup," BioWorld Today 20(103):8 (2009).

Bloomgarden et al.,"Glycemic Treatment in Type 1 and Type 2 Diabetes," Diabetes Care 29(11):2549-2555 (2006).

Bookbinder et al., "Biochemical Characterization of Recombinant Human PH20 (SPAM1) Hyaluronidase," Hyaluronan (ISHAS) 2007, Charleston, SC, 2 pages.

Bookbinder et al., "Enhancing Drug Transport Through Temporary Matrix Depolymerization," Keystone Symposia 2005, 13 pages.

Bookbinder et al., "Evaluation of the compatibility and pharmacokinetics of co-formulated biologics with recombinant human hyaluronidase: Dose Response," American Association of Pharmaceutical Scientists Conference, Nov. 2006, 3 pages.

Bookbinder et al., "A Recombinant human enzyme for enhanced interstitial transport of therapeutics," J Control Release 114:230-241 (2006).

Bordier C., "Phase separation of integral membrane proteins in Triton X-114 solution," J Biol Chem. 256(4):1604-1607 (1981).

Bouffard et al., "An in vitro assay for hepatitis C virus NS3 serine proteinase," Virology 209:52-59 (1995).

Brange, J. and A. Volund, "Insulin analogs with improved pharmacokinetic profiles," Adv Drug Deliv Rev 35(2-3):307-335 (1999).

Brange et al., "Monomeric insulins obtained by protein engineering and their medical implications," Nature 333(6174):679-682 (1988).

Brehm et al., "Glucose Clamp Techniques," found in Clinical Diabetes Research: Methods and Techniques, ed., M. Roden, pp. 43-76 (2007).

Brinster et al., "Regulation of metallothionein—thymidine kinase fusion plasmids injected into mouse eggs," Nature 296:39-42 (1982).

Brumeanu et al., "Derivatization with monomethoxypolyethylene glycol of Igs expressing viral epitopes obviates adjuvant requirements," J Immunol. 154:3088-3095 (1995).

Byerley et al., "'Cutting out the bull'. Recombinant human hyaluronidase: Moving to an animal-free system," Association of Clinical Embryologists, 2006, Dublin, Ireland. Abstract published in Human Fertility 9(2):110 (2006).

Caliceti, P. and F. Veronese, "Pharmacokinetic and biodistribution properties of poly(ethylene glycol)-protein conjugates," Adv. Drug Deliv. Rev. 55(10):1261-1277 (2003).
Carr, D. and S. Gabbe, "Gestational diabetes: detection, management, and implications," Clinical Diabetes 16(1):4-11 (1998).
Carrillo et al., "The multiple-sequence alignment problem in biology," SIAM J Applied Math 481:1073-1082 (1988).
Cefalu, W., "Animal models of type 2 diabetes: clinical presentation and pathophysiological relevance to the human condition," ILAR Journal 47(3):186-198 (2006).
Chance et al., "Chemical, physical, and biologic properties of biosynthetic human insulin," Diabetes Care 4(2):147-154 (1993).
Chapman et al., "Therapeutic antibody fragments with prolonged in vivo half-lives," Nature Biotech. 17:780-783 (1999).
Cheng et al., "PEGylated adenoviruses for gene delivery to the intestinal epithelium by the oral route," Pharm. Res. 20(9):1444-1451 (2003).
Cherr et al., "The dual functions of GPI-anchored PH-20: hyaluronidase and intracellular signaling," Matrix Biol. 20:515-525 (2001).
Cherr et al., "The PH-20 protein in cynomolgus macaque spermatozoa: identification of two different forms exhibiting hyaluronidase activity," Dev. Biol. 175:142-153 (1996).
Chiesa et al., "Insulin therapy and carbohydrate counting," Acta Biomed. 76(Suppl 3):44-48 (2005).
Cho et al., "Construction of hepatitis C-SIN virus recombinants with replicative dependency on hepatitis C virus serine protease activity," J. Virol. Meth. (65):201-207 (1997).
Conserved domain search from U.S. Appl. No. 10/795,095 of SEQ ID No. 6, Primakoff et al. US 5,721,348, performed on the NCBI website on Aug. 5, 2008.
Cousens et al., "High level expression of proinsulin in the yeast, *Saccharomyces cerevisiae*," Gene 61(3):265-275 (1987).
Csoka et al., "Purification and microsequencing of hyaluronidase isozymes from human urine," FEBS Lett., 417:307-310 (1997).
Csoka et al., "Hyaluronidases in tissue invasion," Invasion Metastasis 17:297-311 (1997).
Cumber et al., "Structural features of the antibody-A chain linkage that influence the activity and stability of ricin A chain immunotoxins," Bioconj. Chem. 3(5):397-401 (1992).
Danilkovitch-Miagkova, et al., "Hyaluronidase 2 negatively regulates RON receptor tyrosine kinase and mediates transformation of epithelial cells by jaagsiekte sheep retrovirus," Proc Natl Acad Sci USA 100(8):4580-4585 (2003).
Deboer et al., "The tac promoter: a functional hybrid derived from the trp and lac promoters," Proc. Natl. Acad. Sci. USA 80:21-25 (1983).
DeFelippis et al., "Insulin Chemistry and Pharmacokinetics," *Ellenberg and Rifkin's diabetes mellitus*, [edited by] Daniel Porte et al., New York : McGraw-Hill, Health Professions Division, c2003, 6th ed., pp. 481-500.
Del Roio Liberatore et al., "Insulin pump therapy in type 1 diabetes mellitus," Jornal de Pediatria 82(4):249-254 (2006).
Delpech et al., "Enzyme-linked hyaluronectin: a unique reagent for hyaluronan assay and tissue location and for hyaluronidase activity detection," Anal. Biochem. 229:35-41 (1995).
Devereux et al, "A comprehensive set of sequence analysis programs for the VAX," Nucleic Acids Research 12:387-395 (1984).
Duttaroy et al., "Development of a long-acting insulin analog using albumin fusion technology," Diabetes 54(1):251-258 (2005).
Ernst et al., "Enzymatic degradation of glycosaminoglycans," Critical Reviews in Biochemistry and Molecular Biology 30(5):387-444 (1995).
Favre et al, "Hyaluronidase enhances recombinant adeno-associated virus (rAAV)-mediated gene transfer in the rat skeletal muscle," Gene Ther 7(16):1417-1420 (2000).
Federal Register Sep. 23, 1970 (35 FR 14800); Wydase NDA 6-343, (40 pages).
Felix et al., "Pegylated peptides. IV. Enhanced biological activity of site-directed pegylated GRF analogs," Int. J. Peptide Res. 46:253-264 (1995).
Filocamo et al., "Chimeric Sindbis viruses dependent on the NS3 protease of hepatitis C virus," J Virology 71:1417-1427 (1997).

Fox et al., "Method of Preventing Insulin Atrophy," Br Med J 2(4847):1202-1203 (1953).
Frost et al., "HYAL1LUCA-1, a candidate tumor suppressor gene on chromosome 3p21.3, is inactivated in head and neck squamous cell carcinomas by aberrant splicing of pre-mRNA," Oncogene (19):870-878 (2000).
Frost et al., "Punctuated Equilibrium: The Evolution of Recombinant Human Hyaluronidase," Ophthalmic Anesthesia Society, 2006, Chicago, IL, 36 pages.
Frost et al., "Purification, cloning, and expression of human plasma hyaluronidase," Biochem. Biophys. Res. Commun. 236:10-15 (1997).
Frost, G. and R. Stern, "A microtiter-based assay for hyaluronidase activity not requiring specialized reagents," Anal. Biochem. 251:263-269 (1997).
Frost, G., "Recombinant human hyaluronidase (rHuPH20): an enabling platform for subcutaneous drug and fluid administration," Expert Opin. Drug. Deliv. 4:427-440 (2007).
Gardner et al., "The complete nucleotide sequence of an infectious clone of cauliflower mosaic virus by M13mp7 shotgun sequencing," Nucleic Acids Res. 9:2871-2888 (1981).
Gilbert, W. and L. Villa-Komaroff, "Useful Proteins from Recombinant Bacteria," Scientific American 242:79-94 (1980).
Gmachl et al., "The human sperm protein PH-20 has hyaluronidase activity," FEBS 336(3):545-548 (1993).
Gribskov et al., "Sigma factors from E. coli, B. subtilis, phage SP01, and phage T4 are homologous proteins," Nucl. Acids Res. 14:6745-6763 (1986).
Grosschedl et al., "Introduction of a mu immunoglobulin gene into the mouse germ line: specific expression in lymphoid cells and synthesis of functional antibody," Cell 38:647-658 (1984).
Guo et al., "Protein tolerance to random amino acid change," Proc. Nat'l. Acad. Sci. USA, 101:9205-9210, 2004.
Gysin et al., "Hyaluronidase in Insulin Coma Therapy" Diseases of the Nervous System 15(5):138-141 (1953).
Hahm et al., "Generation of a novel poliovirus with a requirement of hepatitis C virus protease NS3 activity," Virology 226:318-326 (1996).
Haller et al., "Enhanze Technology—A Revolution in Drug Dispersion," Biotechnology Industry Organization (BIO) Annual Meeting, 2005, Philadelphia, PA, 4 pages.
Haller et al., "Escaping the Interstitial Matrix With Enzyme-Mediated Drug Delivery," Drug Delivery Technology, 5(5):1-6 (2005).
Haller et al., "Recombinant Human Hyaluronidase for the Interstitial Transport of Therapeutics," American Association of Pharmaceutical Scientists Conference, Jun. 2006, San Antonio, TX, 2 pages.
Haller et al., "The Effects of Recombinant Human Hyaluronidase on Drug Dispersion," American Association of Pharmaceutical Scientists Annual Meeting, 2005, Nashville, TN, 4 pages.
Haller, "Converting Intravenous Dosing to Subcutaneous Dosing with Recombinant Human Hyaluronidase," Pharmaceut Tech. Newsletter, 8 pgs. (Oct. 2007).
Haller, "Enhanze Technology—An Enzymatic Drug Delivery System (DDS)," Japanese Export Trade Organization, 2005, Santa Clara, CA, 2 pages.
Haller, "Focus on Enhanced and Innovative Recombinant Human Enzymes," Japanese Export Trade Organization, Sep. 2004, Chicago, IL, presentation, 15 pages.
Haller, "Halozyme's Enhanze Technology for the Enhanced Dispersion of Co-Injected Pharmaceuticals," Japanese Export Trade Organization, Sep. 2004, Chicago, IL, 2 pages.
Halozyme Therapeutics Investor Presentation, "Company Overview," May 15, 2008. [15 pages].
Halozyme Therapeutics Investor Presentation, "Company Overview," Feb. 12, 2008. [37 pages].
Halozyme Therapeutics Investor Presentation, "Company Overview," Feb. 22, 2007. [25 pages].
Halozyme Therapeutics Investor Presentation, "Company Overview," Jun. 28, 2006. [28 pages].
Halozyme Therapeutics Investor Presentation, "Company Overview," Feb. 1, 2006. [34 pages].
Halozyme Therapeutics Investor Presentation, "Company Overview," Nov. 29, 2005. [34 pages].

Halozyme Therapeutics Investor Presentation, "Focus on enhanced and innovative recombinant human enzymes," Jan. 28, 2005. [28 pages].

Halozyme Therapeutics Investor Presentation, "Focus on enhanced and innovative recombinant human enzymes," Mar. 12, 2004. [32 pages].

Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).

Hamatake et al., "Establishment of an in vitro assay to characterize hepatitis C virus NS3-4A protease trans-processing activity," Intervirology 39:249-258 (1996).

Hammer et al., "Diversity of alpha-fetoprotein gene expression in mice is generated by a combination of separate enhancer elements," Science 235:53-58 (1987).

Hanahan, D., "Heritable formation of pancreatic beta-cell tumours in transgenic mice expressing recombinant insulin/simian virus 40 oncogenes," Nature (3)15:115-122 (1985).

Hanaire, H.,"Continuous glucose monitoring and external insulin pump: towards a subcutaneous closed loop," Diabetes Metab. 32:534-538 (2006).

Harris et al, "Chemistry for peptide and protein PEGylation," Adv. Drug Deliv. Rev. 54(4):459-476 (2002).

Harris, J. and R. Chess, "Effect of pegylation on pharmaceuticals," Nat Rev Drug Discov. 2:214-221 (2003).

Heldin, P., "Importance of hyaluronan biosynthesis and degradation in cell differentiation and tumor formation," Brazilian J. Med. Biol. Res. 36:967-973 (2003).

Herrera-Estrella et al., "Expression of chimaeric genes transferred into plant cells using a ti-plasmid-derived vector," Nature 303:209-213 (1984).

Herrera-Estrella et al., "Light-inducible and chloroplast-associated expression of a chimaeric gene introduced into Nicotiana tabacum using a Ti plasmid vector," Nature 310(5973):115-120 (1984).

Hibi et al., "Chondroitinase C activity of *Streptococcus intermedius*," FEMS-Microbiol-Lett. 48(2):121-124 (1989).

Hirsch et al., "A real-world approach to insulin therapy in primary care practice," Clinical Diabetes 23(2):78-86 (2005).

Hirsch et al., "Insulin analogues," N. Engl J Med 352(2):174-183 (2005).

Hofer, "Human Recombinant Hyaluronidase Increases the Convection of Molecules up to 0.2 μm in Athymic Nude Mice," American Association for Laboratory Animal Science, 2006, Salt Lake City, UT. Abstract published in J. Am. Assoc. Lab. Animal Sci., 45:120, 2006, 2 pages.

Holden et al., "Use of Hyaluronidase in insulin coma therapy," British Medical Journal 2(5036):85-86 (1957).

Hompesch et al "Accelerated Insulin Pharmacokinetics and Improved Glyemic Control in T1DM Patients by Coadministration of Prandial Insulin with Recombinant Human Hyaluronidase" American Diabetes Association, 2 pages.

Hovingh, P. and A. Linker, "Hyaluronidase activity in leeches (Hirudinea)," Comp Biochem Physiol B Biochem Mol Biol. 124(3):319-326 (1999).

Hovorka, R., "Continuous glucose monitoring and closed-loop systems," Diabetic Med. 23:1-12 (2006).

Howey et al., "[Lys(B28), Pro(B29)]-human insulin a rabidly absorbed analogue of human insulin," 43(3):396-402 (1994).

Hunnicut et al., "Structural relationship of sperm soluble hyaluronidase to the sperm membrane protein PH-20," Biol Reprod. 54(6):1343-1349 (1996).

Huston et al., "Protein engineering of antibody binding sites: recovery of specific activity in an anti-digoxin single-chain Fv analogue produced in *Escherichia coli*," Proc. Natl. Acad. Sci. U.S.A. 85(16):5879-5883 (1988).

Ito et al., "Cultivation of hepatitis C virus in primary hepatocyte culture from patients with chronic hepatitis C results in release of high titre infectious virus," J. Gen. Virol. 77:1043-1054 (1996).

IUPAC, "IUPAC-IUB Commission on Biochemical Nomenclature. A one-letter notation for amino acid sequences. Tentative rules," J. Biol. Chem. 243(13):3557-3559 (1968).

IUPAC-IUB, "Abbreviated nomenclature of synthetic poypeptides-polymerized amino acids-revised recommendations," Commission on Biochemical Nomenclature, Biochemistry 11:1726-1731 (1972).

Jay et al., "Construction of a general vector for efficient expression of mammalian proteins in bacteria: use of a synthetic ribosome binding site," Proc. Natl. Acad. Sci. USA 78:5543-5548 (1981).

Jiang et al., "Effects of Recombinant Human PH20 (rHuPH20) on Interstitial Matrices: Creating a Favorable Environment for The Delivery of Cytostatic Agents," American Association for Cancer Research Annual Meeting, 2005, Anaheim, CA, 1 page.

Kalatz et al., "Development of algorithms for feedback-controlled subcutaneous insulin infusion with insulin lispro," Acta Diabetol. 36:215 (1999).

Keller et al., "Pharmacokinetic, Pharmacodynamic and Toxicologic Effects of a Recombinant Human Hyaluronidase (rHuPH20) in Rodent and Non-Human Primate models," Hyaluronan (ISHAS) 2007, Charleston, SC, 2 pages.

Kelsey et al., "Species- and tissue-specific expression of human alpha 1-antitrypsin in transgenic mice," Genes And Devel. 1:161-171 (1987).

Kollias et al., "Regulated expression of human A gamma-, beta-, and hybrid gamma beta-globin genes in transgenic mice: manipulation of the developmental expression patterns," Cell 46:89-94 (1986).

Krumlauf et al., "Developmental regulation of alpha-fetoprotein genes in transgenic mice," Mol. Cell. Biol. 5:1639-1648 (1985).

Ladisch et al., "Recombinant human insulin," Biotechnol. Prog. 8:469-478 (1992).

Ladurner, A. and A. Fersht, "Glutamine, alanine or glycine repeats inserted into the loop of a protein have minimal effects on stability and folding rates," J. Mol. Biol. 273(1):330-337 (1997).

Lalancette et al, "Characterization of an 80-kilodalton bull sperm protein identified as PH-20," Biol Reprod. 65(2):628-636 (2001).

Lathrop et al., "cDNA cloning reveals the molecular structure of a sperm surface protein, PH-20, involved in sperm-egg adhesion and the wide distribution of its gene among mammals," J Cell Biol. 111(6 Pt 2):2939-2949 (1990).

Leder et al., "Consequences of widespread deregulation of the c-myc gene in transgenic mice: multiple neoplasms and normal development," Cell 45:485-495 (1986).

Lin et al., "Molecular cloning of the human and monkey sperm surface protein PH-20," Proc. Natl. Acad. Sci. USA 90:10071-10075 (1993).

Lindholm, "Improved postprandial glycemic control with insulin aspart," Diabetes Care 22(5):801-805 (1999).

Louveau, I. and F. Gondret, "GH and insulin affect fatty acid synthase activity in isolated porcine adipocytes in culture without any modifications of sterol regulatory element binding protein-1 expression," J Endocrin. 181:271-280 (2004).

Lowe et al., "Flexible eating and flexible insulin dosing in patients with diabetes: Results of an intensive self-management course," Diabetes Res. Clin. Pract. 80(3):439-443 (2008).

Lu, H. and E. Wimmer, "Poliovirus chimeras replicating under the translational control of genetic elements of hepatitis C virus reveal unusual properties of the internal ribosomal entry site of hepatitis C virus," Proc. Natl. Acad. Sci (USA) 93:1412-1417 (1996).

Lu, Y. and A. Felix, "Pegylated peptides I: Solid-phase synthesis of N alpha-pegylated peptides using Fmoc strategy," Peptide Res 6:140-146 (1993).

Lu, Y. and A. Felix, "Pegylated peptides. II. Solid-phase synthesis of amino-, carboxy- and side-chain pegylated peptides," Int. J. Peptide Protein Res. 43:127-138 (1994).

Macdonald, R., "Expression of the pancreatic elastase I gene in transgenic mice," Hepatology 7:42S-51S (1987).

Magram et al., "Developmental regulation of a cloned adult beta-globin gene in transgenic mice," Nature 315(6017):338-340 (1985).

Mammalian Gene Collection (MGC) Program Team, "Generation and initial analysis of more than 15,000 full-length human and mouse cDNA sequences," Proc. Natl. Acad. Sci. USA 99:16899-16903 (2002).

Mantovani et al., "Efficacy of varying concentrations of hyaluronidase in peribulbar anaesthesia," British J. Anaesthesia 86:876-878 (2001).

Mason et al., "The hypogonadal mouse: reproductive functions restored by gene therapy," Science 234:1372-1378 (1986).

Mayfield, J. and R. White, "Insulin therapy for type 2 diabetes: rescue, augmentation, and replacement of beta-cell function," Am Fam Physican 70(3):489-500 (2004).

McCowen et al., "Stress-induced hyperglycemia," Crit Clin. Care 17(1):107-124 (2001).

Mehvar, R., "Modulation of the pharmacokinetics and pharmacodynamics of proteins by polyethylene glycol conjugation," J. Pharm. Pharmaceut. Sci. 3(1):125-136 (2000).

Menzel, E. and C. Farr, "Hyaluronidase and its substrate hyaluronan: biochemistry, biological activities and therapeutic uses," Cancer Lett., 131:3-11 (2003).

Michelacci et al., "Chondroitinase C from Flavobacterium heparinum," J. Biol. Chem. 251:1154-1158 (1976).

Mizutani et al., "Characterization of hepatitis C virus replication in cloned cells obtained from a human T-cell leukemia virus type 1-infected cell line, MT-2," J. Virol. 70:7219-7223 (1996).

Mizutani et al., "Inhibition of hepatitis C virus replication by antisense oligonucleotide in culture cells," Biochem. Biophys. Res. Commun., 212:906-911 (1995).

Mizutani et al., "Long-term human T-cell culture system supporting hepatitis C virus replication," Biochem. Biophys. Res. Commun. 227:822-826 (1996).

Molineux, G., "Pegylation: engineering improved biopharmaceuticals for oncology," Pharmacotherapy 23 (8 Pt 2):3S-8S (2003).

Monfardini et al., "A branched monomethoxypoly(ethylene glycol) for protein modification," Bioconjugate Chem. 6(1):62-69 (1995).

Mooradian et al., "Narrative review: a rational approach to starting insulin therapy," Ann Intern Med 145(2):125-134 (2006).

Needleman, S. and C. Wunsch "A general method applicable to the search for similarities in the amino acid sequence of two proteins," J Mol Biol. 48:443-453 (1970).

News Release, Halozyme Therapeutics Inc. Q4 2007 Earnings Call Transcript found at: http://seekingalpha.com/article/68609-halozyme-therapeutics-q4-2007-earnings-call-transcript [accessed on Jun. 24, 2009] [12 pages].

News Release, Halozyme Therapeutics Inc., "Halozyme and Baxter Announce Availability of Hylenex for Subcutaneous Delivery of Medications and Fluids," San Diego, CA, Jun. 27, 2006, http://phx.corporate-ir.net/phoenix.zhtml?c=175436&p=irol-newsArticle&ID=876530&highlight=[accessed on Jan. 6, 2009] [3 pages].

News Release, Halozyme Therapeutics Inc., "Halozyme Therapeutics Begins Phase 2 Clinical Trial of Insulin With rHuPH20 in Type 1 Diabetic Patients," San Diego, CA, Nov. 3, 2008, http://phx.corporate-ir.net/phoenix.zhtml?c=175436&p=irol-newsArticle_Print&ID=1220870&highlight= [accessed on Jan. 6, 2009] [2 pages].

News Release, Halozyme Therapeutics Inc., "Halozyme Therapeutics Announces Phase I Clinical Trial Results Demonstrating that the Combination of Recombinant Human Hyaluronidase (rHuPH20) With Humulin R(R) and with Humalog(R) Yields Faster, More Physiologic Insulin Kinetics and Better Predictability," San Francisco, CA, Jun. 9, 2008, http://phx.corporate-ir.net/phoenix.zhtml?c=175436&p=irol-newsArticle_Print&ID=1163612&highlight= [accessed on Jan. 6, 2009] [3 pages].

News Release, Halozyme Therapeutics Inc., "Halozyme Therapeutics Announces FDA Acceptance of Hylenex NDA," San Diego, CA, May 26, 2005, http://phx.corporate-ir.net/phoenix.zhtml?c=175436& p=irol-newsArticle_Print&ID=714327&highlight= [accessed Jan. 6, 2009] [2 pages].

News Release, Halozyme Therapeutics Inc., "Halozyme Therapeutics Files NDA for Enhanze SC," San Diego, CA, Mar. 28, 2005, http://phx.corporate-ir.net/phoenix.zhtml?c=175436&p=irol-newsArticle_Print&ID=689194&highlight= [accessed on Jan. 6, 2009] [2 pages].

News Release, Halozyme Therapeutics Inc., "Halozyme Therapeutics and Baxter Healthcare Corporation Announce FDA Approval of Hylenex," San Diego, CA, and Deerfield, IL, Dec. 5, 2005, http://phx.corporate-ir.net/phoenix.zhtml?c=175436&p=irol-newsArticle_Print&ID=792608&highlight=[accessed Jan. 6, 2009] [3 pages].

News Release, Halozyme Therapeutics Inc., Q1 2008 Earnings Call Transcript found at: http://seekingalpha.com/article/76655-halozyme-therapeutics-inc-q1-2008-earnings-call-transcript [accessed on Jun. 25, 2009] [14 pages].

News Release, Halozyme Therapeutics Inc., Q4 2008 Earnings Call Transcript found at: http://seekingalpha.com/article/125929-halozyme-therapeutics-inc-q4-2008-earnings-call-transcript [accessed on May 13, 2009] [12 pages].

Newton et al., "Angiogenin single-chain immunofusions: influence of peptide linkers and spacers between fusion protein domains," Biochemistry 35(2):545-553 (1996).

Ohya, T. and Y. Kaneko, "Novel hyaluronidase from streptomyces," Biochim. Biophys. Acta 198:607-609 (1970).

Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).

Oupicky et al., "Stabilization of polycation-DNA complexes by surface modification with hydrophilic polymers," in: Methods in Molecular Medicine, vol. 65: Nonviral Vectors for Gene Therapy, Findeis, ed., Humana Press, Totowa, NJ, pp. 61-64 (2001).

Pargiter et al., "Use of hyaluroniase in insulin coma" Dis Nerv Syst May 1957; 18(5):194-5.

Pearson, W. and D. Lipman "Improved tools for biological sequence comparison," Proc. Natl. Acad. Sci. USA 851:2444-2448 (1988).

Pham et al., "Large-scale transient transfection of serum-free suspension-growing HEK293 EBNA1 cells: peptone additives improve cell growth and transfection efficiency," Biotechnology and Bioengineering 84:332-342 (2003).

Pinkert et al., "An albumin enhancer located 10 kb upstream functions along with its promoter to direct efficient, liver-specific expression in transgenic mice," Genes and Devel. 1:268-276 (1987).

Pinkstaff et al., "Evaluation of the Compatibility and Pharmacokinetics of Co-formulated Biologics with Recombinant Human Hyaluronidase: Dose Response," American Association of Pharmaceutical Scientists Conference, Jun. 2006, San Antonio, TX, 3 pages.

Pinkstaff et al., "Recombinant Human Hyaluronidase for Drug and Fluid Dispersion," American Association of Pharmaceutical Scientists Annual Meeting, Nov. 2006, Boston, MA, 3 pages.

Pirrello et al., "Initial experiences with subcutaneous recombinant human hyaluronidase," J Palliat Med. 10(4):861-864 (2007).

Readhead et al., "Expression of a myelin basic protein gene in transgenic shiverer mice: correction of the dysmyelinating phenotype," Cell 48:703-712 (1987).

Roberts et al., "Chemistry for peptide and protein PEGylation," Advanced Drug Delivery Review 54:459-476 (2002).

Rosskamp et al., "Long-acting insulin analogs," Diabetes Care 22(Suppl.2):B109-B113 (1999).

Saha et al., "Acute hyperglycemia induced by ketamine/xylazine anesthesia in rats: mechanisms and implications for preclinical models," Exp. Biol. Med. 230:777-784 (2005).

Sato et al., "Cloning and expression in *Escherichia coli* of the gene encoding the Proteus vulgaris chondroitin ABC lyase," Appl. Microbiol. Biotechnol. 41(1):39-46 (1994).

Sato, H., "Enzymatic procedure for site-specific pegylation of proteins," Adv. Drug Deliv. Rev. 54:487-504 (2002).

Schwartz and Dayhoff, eds., Atlas of Protein Science and Structure, National Biomedical Research Foundation, pp. 353-358 (1979).

Sequence alignments from U.S. Appl. No. 10/795,095 search of SEQ ID No. 1 in the Issued Patents database, performed on Sep. 25, 2007. 13 pages.

Shani, M., "Tissue-specific expression of rat myosin light-chain," Nature 314:283-286 (1985).

Shekhar et al., "The matrix reloaded: halozyme's recombinant enzyme helps injected drugs spread faster," Chem. Biol. 14:603-604 (2007).

Shichiri et al. (Artif. Organs (1998) 22:32-42).

Shimizu, Y. and H. Yoshikura, "Multicycle infection of hepatitis C virus in cell culture and inhibition by alpha and beta interferons," J. Virol. 68:8406-8408 (1994).

Shimoda et al., "Closed-loop subcutaneous insulin infusion algorithm with a short-acting insulin analog for long-term clinical application of a wearable artificial endocrine pancreas," Front Med Biol Eng (1997) 8(3):197-211 (1997).

Smith, T. and M. Waterman, "Comparison of biosequences," Advances in Applied Mathematics 2:482-489 (1981).

Soeborg et al., "Absorption kinetics of insulin after subcutaneous administration," Eur. J. Pharm. Sci. 36:78-90 (2009).

Steil et al., "Modeling beta-cell insulin secretion—implications for closed-loop glucose homeostasis," Diabetes Technol Ther 5(6):953-964 (2003).

Steinkuhler et al., "Product inhibition of the hepatitis C virus NS3 protease," Biochem. 37:8899-8905 (1998).

Stem, R., "Devising a pathway for hyaluronan catabolism: are we there yet?" Glycobiology 13:105R-115R (2003).

Straccia et al., "Hyaluroidase as an adjunct in insulin coma therapy," Am J Psychiatry 108:702-703 (1952).

Sudo et al., "Establishment of an in vitro assay system for screening hepatitis C virus protease inhibitors using high performance liquid chromatography," Antiviral Res. 32:9-18 (1996).

Sugarman et al., "Recombinant Human Hyaluronidase (rHuPH20) accelerates insulin pharmacokinetics in dogs," AAPS National Biotechnology Conference presented on Jun. 23, 2009, 2 pages.

Swift et al., "Tissue-specific expression of the rat pancreatic elastase I gene in transgenic mice," Cell 38:639-646 (1984).

Takahashi et al., "A fluorimetric Morgan-Elson assay method for hyaluronidase activity," Anal. Biochem. 322:257-263 (2003).

Takeshita et al., "An enzyme-linked immunosorbent assay for detecting proteolytic activity of hepatitis C virus proteinase," Anal. Biochem. 247:242-246 (1997).

Taliani et al., "A continous assay of hepatitis C virus protease based on resonance energy transfer depsipeptide substrates," Anal. Biochem. 240:60-67 (1996).

Tkalec et al., "Isolation and expression in *Escherichia coli* of cslA and cslB, genes coding for the chondroitin sulfate-degrading enzymes chondroitinase AC and chondroitinase B, respectively, from *Flavobacterium heparinum*," Applied and Environmental Microbiology 66(1):29-35 (2000).

"Towards an artificial pancreas," Published by Roche, located at: www.roche.com/pages/downloads/science/pdf/rtdcmannh02-6.pdf, 11 pages.

Tsubery et al., "Prolonging the action of protein and peptide drugs by a novel approach of reversible polyethylene glycol modification," J Biol. Chem 279(37):38118-38124 (2004).

Tsuda et al., "Substrate specificity studies of Flavobacterium chondroitnase C and heparitinases towards the glycosaminoglycan—protein linkage region. Use of a sensitive analytical method developed by chromophopre-labeling of linkage glycoserines using dimethylaminoazobezenesulfonyl chloride," Eur. J. Biochem. 262:127-133 (1999).

Tyndel, M., "Hyaluronidase as an adjuvant in insulin shock therapy," J Am Med Assoc 162(1):32-34 (1956).

UniProKB/Swiss-Prot entry P01308, Entry name: INS_HUMAN, Primary accession No. P01308, updated last on Jul. 28, 2009, Version 135 and found at http://beta.uniprot.org/uniprot/P01308 [accessed on Aug. 5, 2009] [23 pages].

UniProKB/Swiss-Prot entry P30410, Entry name: INS_PANTR, Primary accession No. P30410, updated last on Jun. 16, 2009, Version 39 and found at http://beta.uniprot.org/uniprot/P30410 [accessed on Aug. 5, 2009] [7 pages].

UniProKB/Swiss-Prot entry Q8HXV2, Entry name: INS_PONPY, Primary accession No. Q8HXV2, updated last on Jul. 28, 2009 and found at http://beta.uniprot.org/uniprot/Q8HXV2 [accessed on Aug. 5, 2009] [6 pages].

USP XXII-NF XVII, United States Pharmacopeia Convention, Inc, Rockville, MD., pp. 644-645 (1990).

Van den Berghe et al., "Intensive insulin therapy in the medical ICU," N. Eng. J Med. 354(5):449-461 (2006).

Vaughn et al., "Accelerated pharmacokinetics and glucodynamics of prandial insulins injected with recombinant human hyaluronidase," Diabetes Technology & Therapeutics 11(6):345-352 (2009).

Veronese et al., "An improved procedure for the synthesis of branched polyethylene glycols (PEGs) with the reporter dipeptide Met-betaAla for protein conjugation," Bioorg. Med. Chem. Lett. 12(2):177-180 (2002).

Veronese et al., "Branched and linear poly(ethylene glycol): Influence of the polymer structure on enzymological, pharmacokinetic, and immunological properties of protein conjugates," J. Bioactive Compatible Polymers 12:196-207 (1997).

Vora et al., "Recombinant DNA derived monomeric insulin analogue: comparison with soluble human insulin in normal subjects," BMJ (Clinical research ed.) 297(6658):1236-1239 (1988).

Wagner et al., "Nucleotide sequence of the thymidine kinase gene of herpes simplex virus type 1," Proc. Natl. Acad. Sci. USA 78:1441-1445 (1981).

Wang et al., "The molecular physiology of hepatic nuclear factor 3 in the regulation of gluconeogenesis," J. Biol Chem. 275(19):14717-14721 (2000).

Wei et al., "Structure function analysis of the human hyaluronidase enzymes," American Society for Matrix Biology Biennial Meeting, San Diego, CA, Dec. 5, 2008, B4.

Weinzimer et al "Fully automated closed-loop insulin delivery versus semiautomated hybrid control in pediatric patients with type 1 diabetes using an artificial pancreas," Diabetes Care 31(5):934-939 (2008).

Weiss et al., "Activities of monomeric insulin analogs at position A8 are uncorrelated with their thermodynamic stabilities," J. Biol. Chem. 276(43):40018-40024 (2001).

Whitlow et al., "An improved linker for single-chain Fv with reduced aggregation and enhanced proteolytic stability," Protein Engineering 6(8):989-995 (1993).

Wilson, M., "Enhanze Technology—An Enzymatic Drug Delivery System (DDS)," Japanese Export Trade Organization, 2005, Santa Clara, CA, 22 pages.

Yamagata, et al., "Purification and properties of bacterial chondroitinases and chondrosulfatases," J. Biol. Chem. 243(7):1523-1535 (1968).

Yamamoto et al., "Identification of a functional promoter in the long terminal repeat of Rous sarcoma virus," Cell 22:787-797 (1980).

Yang et al., "Purification and characterization of heparinase from *Flavobacterium heparinum*," J. Biol. Chem. 160(30):1849-1857 (1985).

Yocum et al., "Assessment and Implication of the Allergic Sensitivity to a Single Dose of Recombinant Human Hyaluronidase Injection: A Double-Blind Placebo-Controlled Clinical Trial," J Infus Nursing. 30:293-299 (2007).

Yocum et al., "Pharmacokinetics and glucodynamics of an insulin analog and regular insulin injected with recombinant human hyaluronidase: Fast-acting insulins made faster," American Diabetes Association 68th Scientific Sessions, San Francisco, CA, Jun. 6-10, 2008, 2 pages.

Zalipsky, S and C Lee, "Poly(ethylene glycol) Chemistry: Biotechnical and Biomedical Applications," J.M. Hams, ed., Plenum, NY, 1992, cf. chapter 21.

BioWorld Today, "Clinic Roundup," BioWorld Today 21(236):2 (2010).

Halozyme Therapeutics, "Securities and Exchange Commission Form 10Q," Aug. 6, 2010 [41 pages].

Halozyme Therapeutics, "Securities and Exchange Commission Form 10Q," Nov. 5, 2010 [45 pages].

Halozyme Therapeutics, Securities and Exchange Commission Form 8-K, Jan. 10, 2011 [43 pages].

Halozyme Therapeutics, J.P. Morgan 29th Annual Healthcare Conference Presentation, Jan. 12, 2011 [35 pages].

Halozyme Therapeutics, "Matrix Therapies for Life" Presented at Canaccord Cardiovascular, Diabetes & Obesity Conference, Dec. 8, 2010 [38 pages].

Krueger, J., "Sanofi-Aventis seeks the holy grail of insulin," published Sep. 28, 2010, Retrieved from the Internet: <URL:seekingalpha.com/article/227333-sanofi-aventis-seeks-the-holy-grail-of-insulin?source=from_friend, [accessed on Oct. 1, 2010] [6 pages].

News Release, "Coinjection of Halozyme's rHuPH20 enzyme accelerates absorption and action of mealtime insulin analogs," published Jun. 28, 2010, Retrieved from the Internet: <URL:phx.corporate-ir.net/phoenix.zhtml?c=175436&p=irolnewsArticle_print&ID=1442388&highlight=, [accessed on Sep. 1, 2010] [2 pages].

News Release, "Halozyme Therapeutics Inc., Second Quarter 2010 Financial Results Conference Call Transcript," Moderator: Uhl, R., Aug. 6, 2010, [accessed on Sep. 2, 2010] [16 pages].

News Release, Halozyme Therapeutics Reports Second Quarter 2010 Financial Results Aug. 6, 2010, retrieved from the Internet<URL:phx.corporate-ir.net/phoenix.zhtml?c=175436&p=irolnewsArticle_print&ID=1457558&highlight=, [retrieved on Sep. 1, 2010] [5 pages].

News Release, "Halozyme's Ultrafast Insulin Accelerates Absorption and Lowers Hyperglycemia and Hypoglycemia Risk in Type 2 Diabetes Patients," Jun. 27, 2010, retrieved from the Internet:<URL:phx.corporate-ir.net/phoenix.zhtml?c=175436&p=irolnewsArticle_print&ID=1442310&highlight=, [retrieved on Sep. 1, 2010] [3 pages].

News Release, Halozyme Therapeutics Inc., "First Quarter 2010 Financial Results Conference Call," from May 7, 2010 [16 pages].

News Release, Halozyme Therapeutics Inc., "Halozyme's rHuPH20 with Recombinant Insulin Demonstrates Glycemic Control Comparable to Lispro," San Diego, CA, from Nov. 12, 2010, retrieved from the Internet:<URL: phx.corporate-ir.net/phoenix.zhtml?c=175436&p=irol-newsArticle&ID=1495977&highlight=, [accessed on Nov. 19, 2010] [3 pages].

News Release, "Halzoyme Therapeutics Reports Third Quarter 2010 Financial Results." San Diego, CA Nov. 5, 2010, Retrieved from the Internet: <URL: phx.corporate-ir.net/phoenix.zhtml?c=175436&p=irol-newsArticle&ID=1492590&highlight—, [accessed Nov. 19, 2010] [5 pages].

News Release, "Halozyme Therapeutics Awarded Four Qualifying Therapeutic Discovery Project Grants," San Diego, CA Nov. 4, 2010, Retrieved from the Internet: <URL phx.corporate-ir.net/phoenix.zhtml?c=175436&p=irol-newsArticle&ID=1491739&highlight=, [accessed Nov. 19, 2010] [2 pages].

News Release, "Halozyme Therapeutics Announces Implementation of Development Focused Strategy" San Diego, CA Oct. 11, 2010, Retrieved from the Internet: <URL:phx.corporate-ir.net/phoenix.zhtml?c=175436&p=irol-newsArticle&ID=1481205&highlight=, [accessed Nov. 19, 2010] [2 pages].

Connor et al., "Identification of a Suitable Animal Model for Comparative Pharmacokinetics of Insulin Formulated with Recombinant Human Hyaluronidase," American Diabetes Association Scientific Sessions held Jun. 27, 2010 in Orlando FL., poster [1 page].

Halozyme Therapeutics, Analyst and Investor Meeting presentations "Matrix Therapeutics for Life" presentations including Lim, J., "Introduction and strategy overview, Roche program update," Gustafson, K., "Strategic deployment of cash," Wasserman, R., "HyQ treatment of primary immunodeficiency patients," Muchmore, D., "Ultrafast insulin-clinical results and ongoing trials," Cefalu, W., "Unmet needs in diabetes management," Little, R., Market overview-ultrafast insulin and SC immunoglobin and Frost, G., "PEGPH20 and HTI-501 status report," Presented Oct. 14, 2010 in New York, NY. [124 pages].

Hompesch et al., "Accelerated Insulin PK and Improved Glycemic Control in T2DM Patients by Coinjection of Prandial Insulin with Hyaluronidase," American Diabetes Association Scientific Sessions held Jun. 27, 2010 in Orlando FL., poster [1 page].

Jefferies 2010 Global Life Sciences Conference Call transcript on Jun. 8, 2010, Retrieved from the Internet: <URL:wsw.com/webcast/jeff46/hzym/, [7 pages].

Morrow et al., "Human Hyaluronidase Coinjection Accelerates Insulin Pharmacokinetics and Glucodynamics of 3 Rapid Insulin Analogs," American Diabetes Association Scientific Sessions Jun. 28, 2010 in Orlando FL., American Diabetes Association Scientific Sessions held Jun. 28, 2010 in Orlando FL., oral presentation [18 pages].

International Preliminary Report on Patentability, issued Sep. 8, 2010 in connection with corresponding International Application No. PCT/US2009/002625 [15 pages].

Aoki et al, "Role of the mucous/glycocalyx layers in insulin permeation across the rat ileal membrane," International Journal of Pharmaceutics 297(1-2):98-109 (2005).

Annual Report, Halozyme Therapeutics, "Pivotal 09 Progress" published Apr. 2, 2010.

Haller, M., "Enzyme-facilitated Parenteral Drug Transport." Strategic Research Institute's 10th Anniversary Drug Delivery Technology and Deal-making Summit, 2005 New Brunswick, NJ [24 pages].

Haller et al., "Recombinant Human Hyaluronidase for the Interstitial Transport of Therapeutics," Controlled Release Society Conference, Vienna, Austria, 2006, 2 pages.

Haller et al., "Revolutionizing Drug Dispersion with Enhanze Technology," American Association of Pharmaceutical Scientists Annual Meeting, Nov. 6-10, 2005 poster, Nashville, TN, poster, 1 page.

Halozyme Therapeutics, "Exclusive Distribution Agreement," Aug. 13, 2004, 13 pages.

Halozyme Therapeutics, "Non-Exclusive Distribution Agreement," Jan. 30, 2004, 19 pages.

Halozyme Therapeutics, "Non-Exclusive Distribution Agreement," Feb. 9, 2004, 21 pages.

Halozyme Therapeutics, "Non-Exclusive Distribution Agreement," Apr. 13, 2004, 22 pages.

Halozyme Therapeutics, "Securities and Exchange Comission Form SB-2," Mar. 23, 2004, 102 pages. (cumulase and enhanze).

Halozyme Therapeutics, "Securities and Exchange Comission Amendment No. 1 to Form SB-2," Jun. 21, 2004, 108 pages. (cumulase enhanze).

Halozyme Therapeutics, "Securities and Exchange Comission Form 10-QSB," Nov. 12, 2004, 34 pages.

Halozyme Therapeutics, "Securities and Exchange Comission Form S-3," Nov. 12, 2004, 30 pages.

Halozyme Therapeutics, "Securities and Exchange Comission Form 10K," Mar. 12, 2010 [121 pages].

Halozyme Therapeutics, "Securities and Exchange Comission Form 10Q," Nov. 6, 2009 [45 pages].

Halozyme Therapeutics, "Securities and Exchange Comission Form 10Q," Aug. 7, 2009 [45 pages].

Halozyme Therapeutics, "Halozyme Therapeutic, Inc. Prospectus Supplement," Jun. 23, 2009 [85 pages].

Halozyme Therapeutics, "Securities and Exchange Comission Form 10K," Mar. 13, 2009 [122 pages].

Halozyme Therapeutics, "Securities and Exchange Comission Form 10-KSB," Mar. 11, 2005 [45 pages].

Halozyme Therapeutics, "Securities and Exchange Comission Form 10-KSB," Mar. 24, 2006 [50 pages].

Halozyme Therapeutics, "Securities and Exchange Comission Form 10K," Mar. 2007 [108 pages].

Hompesch et al "Accelerated Insulin Pharmacokinetics and Improved Glycemic Control in T1DM Patients by Coadministration of Prandial Insulin with Recombinant Human Hyaluronidase" Part 2, European Association for the Study of Diabetes, Sep. 29-Oct. 2, 2009.

Jefferies Investor Presentation "Matrix Therapies for Life" New York, Jun. 17, 2009 [30 pages].

Lim et al "Matrix Therapies for life" 28th Annual JP Morgan Healthcare Conference San Francisco Jan. 13, 2010, 42 pages.

Meyer et al., "The soluble hyaluronidase from bull testes is a fragment of the membrane-bound PH-20 enzyme," FEBS Letters 413(2):385-388 (1997).

New Release, "Halozyme Therapeutics Reports Fourth Quarter and Year End 2008 Financial Results," Mar. 13, 2009, retrieved from the Internet:<URL: sec.gov/Archives/edgar/data/1159036/000129993309001189/exhibit1.htm [retrieved on Mar. 30, 2010] [5 pages].

New Release, "Halozyme Therapeutics Reports Fourth Quarter and Year End 2009 Financial Results," Mar. 12, 2010, retrieved from the Internet:<URL: prnewswire.com/news-releases/halozyme-therapeutics-reports-fourth-quarter-and-year-end-2009-financial-results-87451832.html [retrieved on Mar. 30, 2010] [5 pages].

News Release, Halozyme Therapeutics Inc., "Halozyme Therapeutics and Baxter Healthcare Corporation Sign Exclusive Sales and Marketing Agreement for Halozyme's Investigational Therapeutic, Enhanze SC," Aug. 16, 2004, retrieved from the Internet:<URL: sec.gov/Archives/edgar/data/1159036/000095013704006885/a01296exv99w1.txt, [retrieved on Mar. 29, 2010] [2 pages].

News Release, Halozyme Therapeutics Inc., "Halozyme Therapeutics Reports Second Quarter Financial Results" Aug. 16, 2004, retrieved from the Internet:<URL: sec.gov/Archives/edgar/data/1159036/000095013704006885/a01296exv99w2.txt, [retrieved on Mar. 29, 2010] [3 pages].

News Release, Halozyme Therapeutics Inc., "Halozyme Therapeutics Reports Third Quarter 2004 Financial Results" Nov. 12, 2004, retrieved from the Internet:<URL: sec.gov/Archives/edgar/data/1159036/000095013704009868/a03367exv99w1.txt, [retrieved on Mar. 29, 2010] [4 pages].

News Release, Halozyme Therapeutics Inc., "Halozyme Therapeutics Reports Second Quarter 2009 Financial Results" Aug. 7, 2009, retrieved from the Internet:<URL: sec.gov/Archives/edgar/data/1159036/000129993309003275/exhibit1.htm, [retrieved on Mar. 20, 2010] [5 pages].

News Release, Halozyme Therapeutics Inc., "Halozyme Therapeutics Reports 2008 Second Quarter Financial Results" Aug. 8, 2008, retrieved from the Internet:<URL: sec.gov/Archives/edgar/data/1159036/000129993308003838/exhibit1.htm, [retrieved on Mar. 30, 2010] [5 pages].

News Release, Halozyme Therapeutics Inc., "Halozyme Therapeutics, Inc. Study Results Show Faster Insulin Absorption When Administered in Combination With Wide Range of PH20 Enzyme Concentrations" Oct. 21, 2009, retrieved from the Internet:<URL: in.reuters.com/money/quotes/keyDevelopments?symbol=HALO.O [retrieved on Apr. 27, 2010] [1 page].

"Pharmacokinetic and Glucodynamic Crossover Study of SC Administered Insulin Lispro + rHuPH20 and Regular Human Insulin + rHuPH20 Compared to Lispro alone," retrieved from the Internet:<URL: clinicaltrials.gov/ct2/show/NCT00862849, First Received Mar. 13, 2009 [accessed on Apr. 26, 2010] [4 pages].

BioWorld Today, "Clinic Roundup," BioWorld Today 20(187):9 (2009).

BioWorld Today, "Clinic Roundup," BioWorld Today 20(190):8 (2009).

BioWorld Today, "Earnings Roundup," BioWorld Today 20(205):1, 6 (2009).

Bonito, A., "Effect of hyaluronidase administration on glycemic curves due to insulin in normal and diabetic subjets," Minerva Medica, Edizioni Minerva Medica, Torino, IT, vol. 45(31):, Apr. 18, 1954 pp. 1068-1073 (1954). [in the Italian language].

Certified English language translation of Bonito, A., "Effect of hyaluronidase administration on glycemic curves due to insulin in normal and diabetic subjets," Minerva Medica, Edizioni Minerva Medica 45(31):1068-1073 (1954).

Certified English language translation of Jost, F., "Zur Insulinempfidlichkeit der schizophrenen," Weiner Klinische Wochenschrift 70(36):657-661 (1958).

Certified English language translation of Keup, W., "Amorphes Insulin und Hyaluronidase in de Insulinbehandlung der psychosen," Schweizerische Medizinische Wochenschrift 87(35-36):1128-1131 (1957).

Certified English language translation of Reit Correa et al., "Potentialization of the action of insulin by hyaluronidase" annales d'endocrinologie 23:27 (1962).

Certified English language translation of Voyer et al., "Insulinotherapie avec alidase en plusieurs injections," L'Union Med. Canada 86:861-865 (1957).

Endriconology—Halozyme Therapeutics, retrieved from: www.halozyme.com/products_endocrinology.php [2 pages] [accessed on Jan. 21, 2010].

Form 10-Q for Halozyme Therapeutics dated May 8, 2009, retrieved from: http://biz.yahoo.com/e/090508/halo10-q.html [accessed on Nov. 25, 2009] [6 pages].

Halozyme Therapeutics, Analyst and Investor Meeting presentations including by Lim, J., "Introduction and strategic review," Little, R., "Leveraging the technology across multiple partners," Frost, G., "Discovery and early development pipeline update," and D. Muchmore, "Ultrafast insulin-PH20 program-where we are going." Presented Oct. 15, 2009 in New York. (88 pages).

Heller et al, "Insulin's 85th anniversary—An enduring medical miracle," Diabetes Research and Clinical Practice 78(2):149-158 (2007).

Jost, F., "Zur Insulinempfidlichkeit der schizophrenen," Weiner Klinische Wochenschrift 70(36):657-661 (1958). [in the German language].

Keup, W., "Amorphes Insulin und Hyaluronidase in de Insulinbehandlung der psychosen," Schweizerische Medizinische Wochenschrift 87(35-36):1128-1131 (1957). [in the German language].

Kriel, K., "Hyaluronidases—a group of neglected enzymes," Protein Sci. 4(9):1666-1669 (1995).

Modena et al., "Hyaluronidase-injectable microparticles intended for the treatment of extravasation," J. Microencapsulation, 15(1):85-92 (1998).

Morishita et al., "In situ ileal absorption of insulin in rats: effects of hyaluronidase pretreatment diminishing the mucous/glycocalyx layers," Pharm Res. 21(2):309-316 (2004).

News Release, Halozyme Study Results Demonstrate Significantly Less Absorption Variability for Insulin Lispro Administered with PH20 Enzyme, retrieved from: www.earthtimes.org/articles/show/halozyme-study-results-demonstrate-significantly,1033422.shtml [3 pages] [accessed on Jan. 22, 2010].

News Release, Halozyme Therapeutics Inc. Q3 2008 Earnings Call Transcript retrieved from: seekingalpha.com/article/106797-halozyme-therapeutics-inc-q3-2008-earnings-call-transcript?page=-1 [accessed on Nov. 6, 2009] [9 pages].

News Release, Halozyme Therapeutics Inc. Q3 2009 Earnings Call Transcript retrieved from: seekingalpha.com/article/171883-halozyme-therapeutics-inc-q3-2009-earnings-call-transcript?page=-1 [accessed on Nov. 6, 2009] [11 pages].

Reit Correa, P. and E. Magalhaes, "Potentialization of the action of insulin by hyaluronidase" annales d'endocrinologie 23-27 (1962). [in the French language].

STN GEN Caesar accession No. 1625, File IMSDRUGNEWS citing: "rHuPH20 Halozyme phase change II, USA (diabetes)," R&D Focus Drug News, Nov. 2008 (4 pages).

Voyer et al., "Insulinotherapie avec alidase en plusieurs injections," L'Union Med. Canada 86:861-865 (1957). [in the French language].

Letter/Written Disclosure of the Supplemental Information Disclosure Statement for the above-referenced application, mailed on Apr. 20, 2012, 2 pages.

Hompesch et al., "Improved postprandial glycemic control in patients with type 2 diabetes from subcutaneous injection of insulin lispro with hyaluronidase," Diabetes Technol Ther. 14(3):218-224 (2011). Epub Dec. 2, 2011.

Hompesch et al., "Accelerated insulin pharmacokinetics and improved postprandial glycemic control in patients with type 1 diabetes after coadministration of prandial insulins with hyaluronidase" Diabetes Care. 34(3):666-668 (2011). Epub Jan. 27, 2011.

Morrow et al., "Reduction in intrasubject variability in the pharmacokinetic response to insulin after subcutaneous co-administration with recombinant human hyaluronidase in healthy volunteers," Diabetes Technol Ther. 13(10):1039-1045(2011). Epub Jun. 9, 2011.

Muchmore et al., "Benefits of blinded continuous glucose monitoring during a randomized clinical trial," J Diabetes Sci Technol. 5(3):676-680 (2011).

Muchmore et al., "The end point is just the beginning," J Diabetes Sci Technol. 5(5):1287-1289 (2011).

Vaughn, D. and D. Muchmore, "Use of recombinant human hyaluronidase to accelerate rapid insulin analogue absorption: experience with subcutaneous injection and continuous infusion," Endocr Pract. 17(6):914-921 (2011). Epub Dec. 2, 2011.

News Release, Halozyme Therapeutics, Inc., "Halozyme Therapeutics announces positive results from enzyme-augmented insulin pump trial," Published on Oct. 27, 2011[online][retrieved on Apr. 12, 2012] Retrieved from:<URL: halozyme.com/Investors/News-Releases/News-Release-Details/default.aspx?PressReleaseId=f73c0ld4-cedf-4f65-aab0-a2a33828f55d [3 pages].

News Release, Halozyme Therapeutics, Inc., "Halozyme's ultrafast insulin generates faster-in and faster-out profile for type 1 diabetes patients using insulin pumps," Published on Apr. 14, 2011[online][retrieved on Apr. 12, 2012] Retrieved from:<URL:halozyme.com/Investors/News-Releases/News-Release-Details/2011/Halozymes-Ultrafast-Insulin-Generates-Faster-In-and-Faster-Out-Profile-for-Type-1-Diabetes-Patients-Using-Insulin-Pumps/default.aspx [1 page].

News Release, Halozyme Therapeutics, Inc., "Halozyme presents phase 2 results for regular insulin-PH20 confirming faster insulin absorption and superior glucose control," Published on Oct. 1, 2009[online][retrieved on Apr. 12, 2012] Retrieved from:<URL: halozyme.com/default.aspx?SectionId=5cc5ecae-6c48-4521-alad-480e593e4835&LanguageId=1&PressReleaseId=fcb4ecce-dad9-47c3-871e-09366c64f9ee [1 page].

News Release, Halozyme Therapeutics, Inc., "Halozyme's ultrafast insulin demonstrates reduced variability of insulin absorption for type 1 diabetes patients using insulin pumps," Published on Jun. 24, 2011[online][retrieved on Apr. 12, 2012] Retrieved from:<URL:halozyme.com/ default.aspx?SectionId=5cc5ecae-6c48-4521-alad480e593e4835&LanguageId=l& PressReleaseId=11dd7a86- 2824-441f-b19c-ee06c2c8737d [1 page].

Office Action, received Nov. 30, 2011, in connection with Thai Patent Application No. 0901001860, 4 pages.

Examination Report, issued Nov. 17, 2011, in connection with European Patent Application No. 09739183.3, 9 pages.

Examination and Search Report, received Jul. 9, 2012, in connection with Taiwan Patent Application No. 098113616, 5 pages.

Examination Report, issued Apr. 20, 2012, in connection with Australian Patent Application No. 2009241795, 2 pages.

Office Action and Search Report, issued Aug. 20, 2012 (received Sep. 28, 2012), in connection with corresponding Chinese Patent Application No. 200980124875.X [English Translation], 8 pages.

Office Action and Search Report, received Oct. 4, 2012, in connection with corresponding Chilean Patent Application No. 1014-2009, [English Translation and Original Document in Spanish], 8 pages.

News Release, "rHuPH20 Halozyme phase change II USA (diabetes)" retrieved from STN Database accession No. 2008:5917 abstract, R&D Focus Drug News, published Nov. 10, 2008, 1 page.

Search Report and Written Opinion, issued Jun. 25, 2012 (received Aug. 15, 2012) in connection with Singapore Patent Application No. 201007652-9, 18 pages.

Chowpongpang et al., "Cloning and characterization of the bovine testicular PH-20 hyaluronidase core domain," Biotechnol Lett. 26(15):1247-52 (2004).

Gmachl, M. and G. Kreil, "Bee venom hyaluronidase is homologous to a membrane protein of mammalian sperm," Proc Natl Acad Sci U S A. 90(8):3569-73 (1993).

* cited by examiner

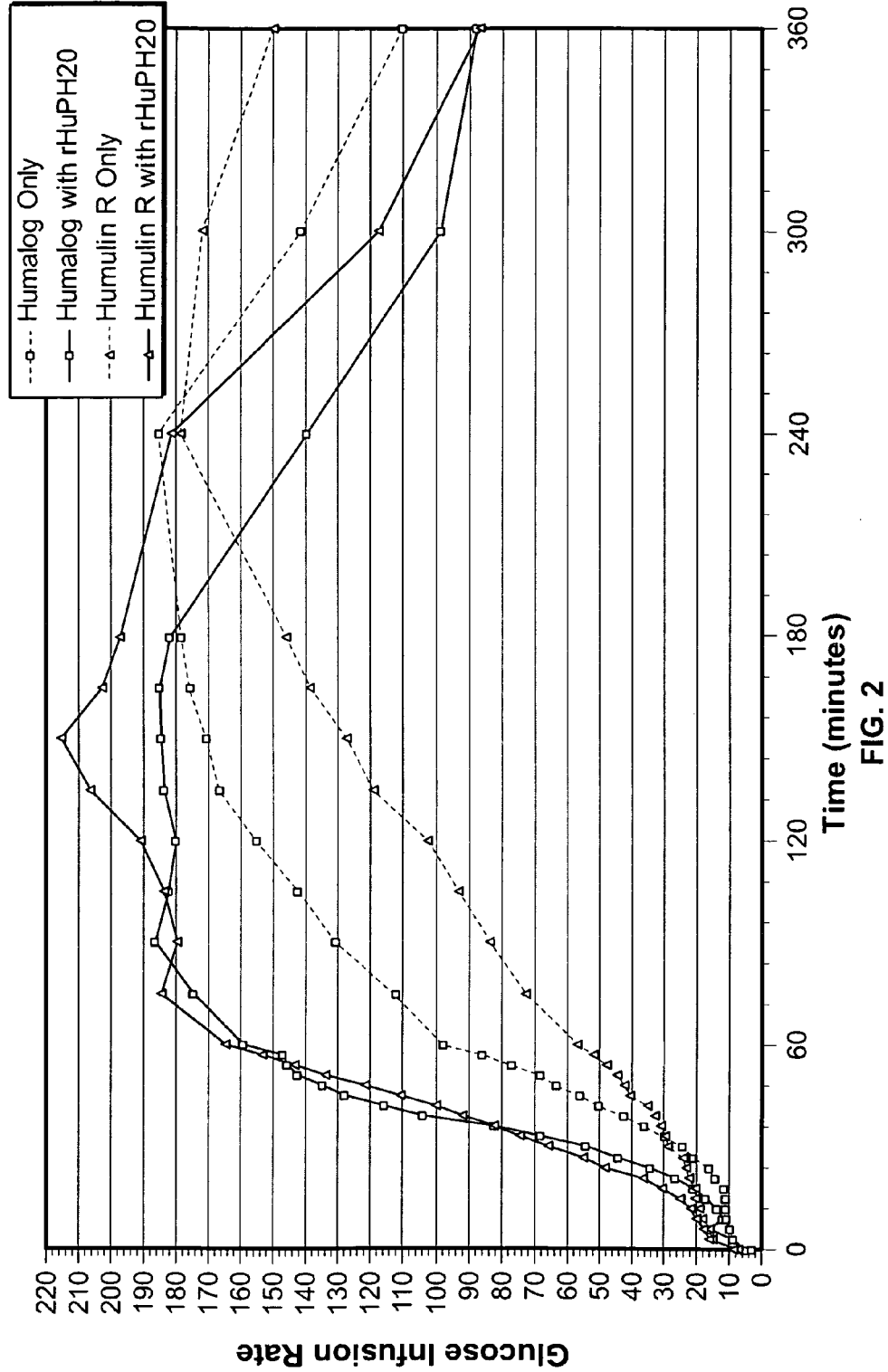

SUPER FAST-ACTING INSULIN COMPOSITIONS

RELATED APPLICATIONS

Benefit of priority is claimed to U.S. Provisional Application Ser. No. 61/125,835, to Gregory Frost, Igor Bilinsky, Daniel Vaughn and Barry Sugarman, entitled "SUPER FAST-ACTING INSULIN COMPOSITIONS," filed Apr. 28, 2008, and U.S. Provisional Application Ser. No. 61/127,044, to Gregory Frost, Igor Bilinsky, Daniel Vaughn and Barry Sugarman, entitled "SUPER FAST-ACTING INSULIN COMPOSITIONS," filed May 9, 2008.

This application is related to corresponding International Application No. PCT/US2009/002625 to Gregory Frost, Igor Bilinsky, Daniel Vaughn and Barry Sugarman, entitled "SUPER FAST-ACTING INSULIN COMPOSITIONS," which also claims priority to U.S. Provisional Application Ser. Nos. 61/125,835 and 61/127,044.

The subject matter of each of the above-referenced applications is incorporated by reference in its entirety.
Incorporation by reference of Sequence Listing Provided on Compact Discs An electronic version on compact disc (CD-R) of the Sequence Listing is filed herewith in duplicate (labeled Copy #1 Replacement Aug. 3, 2009 and Copy #2 Replacement Aug. 3, 2009), the contents of which are incorporated by reference in their entirety. The computer-readable file on each of the aforementioned compact discs, created on Aug. 3, 2009, is identical, 860 kilobytes in size, and titled 3063SEQ.002.txt. A substitute Sequence Listing, incorporated by reference in its entirety, is provided on identical compact discs (labeled Copy 1 Replacement Aug. 8, 2011, Copy 2 Replacement Aug. 8, 2011, and Computer-readable form Replacement), each compact disc containing the file 3063SEQ.003.txt, created on Aug. 8, 2011, and 860 kilobytes in size. A substitute Sequence Listing, incorporated by reference in its entirety, is provided on identical compact discs (labeled Copy #1 Replacement Nov. 10, 2011, Copy #2 Replacement Nov. 10, 2011, and Computer-Readable Form Replacement (CRF)), each compact disc containing the file 3063SEQ.004.txt, created on Nov. 9, 2011, and 860 kilobytes in size.

FIELD OF THE INVENTION

Provided are combinations, compositions and kits containing a fast-acting insulin composition and a hyaluronan degrading enzyme composition formulated for parenteral administration. Such products can be used in methods of treating insulin-treatable diseases or conditions. Also provided are methods for administration of insulin and a hyaluronan degrading enzyme.

BACKGROUND

Diabetes results in chronic hyperglycemia due to the inability of the pancreas to produce adequate amounts of insulin or due to the inability of cells to synthesize and release the insulin appropriately. Hyperglycemia also can be experienced by critically ill patients, resulting in increased mortality and morbidity. Insulin has been administered as a therapeutic to treat patients having diabetes, including, for example, type 1 diabetes, type 2 diabetes and gestational diabetes, in order to mimic the endogenous insulin response that occurs in normal individuals. Insulin also has been administered to critically ill patients with hyperglycemia to control blood glucose levels.

Typically, fast-acting insulins are administered to such subjects in response to hyperglycemia or in anticipation of hyperglycemia, such as following consumption of a meal, which can result in glycemic control. However, current fast-acting forms of insulins have a delay in absorption and action, and therefore do not approximate the rapid endogenous insulin action. Thus, such formulations do not act quickly enough to shut off hepatic glucose production that occurs shortly after this first phase of insulin release. Due to the delay in pharmacological action, the fast-acting insulin preparations should be administered in advance of meals in order to achieve the desired glycemic control. Further, the doses that must be administered lead to an extended duration of action that contributes to hypoglycemia, and in many cases, obesity. Hence, there is a need for alternative insulin compositions that more effectively mimic the endogenous insulin response when administered to a subject, leading to more effective glycemic control and a reduction in the negative side-effects of insulin therapy, such as weight gain.

SUMMARY

Provided are super fast-acting insulin compositions that can act more rapidly and/or increase systemic exposure during a preselected time period compared to fast-acting compositions. Hence, provided are super fast-acting insulin compositions. The compositions contain a therapeutically effective amount of a fast-acting insulin and an amount of a hyaluronan degrading enzyme to render the composition super fast-acting. The compositions are formulated for parenteral administration, such as subcutaneous, intradermal or intramuscular administration. Insulin dosage (amount administered) can be determined by the quantity sufficient to achieve glycemic control, which can be determined empirically, such as by glucose challenge. Typically, a goal in treatment is to administer the lowest possible amount of insulin to achieve glycemic control and reduce the number of hyperglycemic and/or hypoglycemic events. The lower doses of insulin used in the super fast-acting insulin compositions can reduce the risk of weight gain and obesity in diabetic subjects. The compositions can be provided in any suitable container or vehicle, such as in a sterile vial, syringe, cartridge, insulin pen, insulin pump or in a closed loop system reservoir.

Provided herein are super fast-acting insulin compositions containing a therapeutically effective amount of a fast-acting insulin to control blood glucose levels and an amount of a hyaluronan degrading enzyme sufficient to render the composition a super fast-acting insulin composition. Also provided are methods for making super fast-acting insulin compositions, such as any super fast-acting insulin compositions described herein, by selecting a fast-acting insulin and combining it with a sufficient amount of hyaluronan degrading enzyme to render the composition a super fast-acting insulin composition. In some examples of the compositions and methods of making the compositions, the therapeutically effective amount of fast-acting insulin is from or from about 10 U/mL to or to about 500 U/ml insulin, and the sufficient amount of a hyaluronan degrading enzyme to render the composition a super fast-acting insulin composition is functionally equivalent to at least or about 1 U/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL or 25 U hyaluronidase activity/mL. In some examples, the sufficient amount of a hyaluronan degrading enzyme to render the composition a super fast-acting insulin composition is functionally equivalent to at least or about 30 or 35 Units hyaluronidase activity/mL. For example, the amount of fast-acting insulin in the compositions can be or be about 10 U/mL, 20 U/mL, 30 U/mL, 40 U/mL, 50 U/mL, 60 U/mL, 70 U/mL, 80 U/mL, 90 U/mL, 100 U/mL, 150 U/mL, 200 U/mL, 250 U/mL, 300 U/mL, 350 U/mL, 400 U/mL, 450 U/ml or 500 U/mL, and the amount of hyaluronan degrading enzyme in the compositions can be functionally equivalent to or to about 1 U/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL, 25 U/mL, 30 U/mL, 35 U/mL, 37.5 U/mL, 40 U/mL, 50 U/mL, 60 U/mL, 70 U/mL, 80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/ml, 2000 U/mL, 3000 U/mL or 5000 U/mL. The volume of the composition can be, for example, at or about 1 mL, 3 mL, 5 mL, 10 mL, 20 mL or 50 mL. In some examples, the composition is formulated for delivery by a closed loop system, an insulin pen or an insulin pump, and can be formulated for single dose administration or multiple dose administration.

In some embodiments, the therapeutically effective amount of the fast-acting insulin is less than the therapeutically effective amount of fast-acting insulin required to achieve the same therapeutic effect in the absence of the hyaluronan degrading enzyme. The amount of hyaluronan degrading enzyme is sufficient to achieve a systemic exposure to insulin that is at least or about 30% greater over the first 3, 6, 9, 12, 15, 20, 25, 30, 35, 40, 50 or 60 minutes following parenteral administration than the systemic exposure over the same time period following parenteral administration of the same fast-acting insulin without a hyaluronan degrading enzyme and/or is sufficient to achieve systemic glucose metabolism (sometimes referred to herein as glucose clearance) that is at least or about 30% greater over the first 30, 45, 60, 90, 120 or 180 minutes following administration than the systemic glucose metabolism over the same period following parenteral administration of the same fast-acting insulin without a hyaluronan degrading enzyme. In all compositions provided herein and methods provided herein, the amounts of each component can vary depending upon the subject to whom the compositions is administered and/or the particular fast-acting insulin (or mixture thereof) that is provided. If necessary, the amounts can be determined empirically.

Provided are insulin compositions that contain a therapeutically effective amount of a fast-acting insulin and an amount of a hyaluronan degrading enzyme. The amount of hyaluronan degrading enzyme is sufficient to achieve a systemic exposure to insulin that is at least or about 30% greater over the first 30 to 40 minutes following administration than the systemic exposure over the same period following parenteral administration of the same fast-acting insulin in the absence of the hyaluronan degrading enzyme.

The amount of hyaluronan degrading enzyme can be sufficient so that the resulting super fast-acting insulin composition results in a blood glucose level increase after the first 30, 45, 60, 90, 120 or 180 minutes following parenteral administration that is at least or about 20% to 30% lower than the increase in blood glucose levels over the same time period following parenteral administration of the same fast-acting insulin without a hyaluronan degrading enzyme. The increase in blood glucose level can be at least or about 30%, 30%, 35%, 40%, 45%, 50%, 55%, 60%, 65%, 70%, 75% or 80% less than the increase in blood glucose level following parenteral administration of the fast-acting insulin without a hyaluronan degrading enzyme.

Also provided are super fast-acting insulin compositions that contain a therapeutically effective amount of a fast-acting insulin and an amount of hyaluronan degrading enzyme that is sufficient to achieve systemic glucose metabolism that is at least or about 30% greater than systemic glucose clearance (i.e. metabolism) over the first 60 minutes following parenteral administration of the same fast-acting insulin without a hyaluronan degrading enzyme.

In the super fast-acting insulin compositions provided herein, exemplary amounts of insulin (i.e., the amount that the composition provides for a single dosage) are at or about 0.05 Units, 0.06 Units, 0.07 Units, 0.08 Units, 0.09 Units, 0.1 Units, 0.2 Units, 0.3 Units, 0.4 Units, 0.5 Units, 0.6 Units, 0.7 Units, 0.8 Units, 0.9 Units, 1 Unit, 2 Units, 5 Units, 10 Units, 15 Units, 20 Units, 25 Units, 30 Units, 35 Units, 40 Units, 50 Units or 100 Units. Exemplary amounts of hyaluronan degrading enzyme include an amount functionally equivalent to at or about 0.3 Units, 0.5 Units, 1 Unit, 3 Units, 5 Units, 10 Units, 20 Units, 30 Units, 40 Units, 50 Units, 100 Units, 150 Units, 200 Units, 250 Units, 300 Units, 350 Units, 400 Units, 450 Units, 500 Units, 600 Units, 700 Units, 800 Units, 900 Units, 1000 Units, 2,000 Units, 3,000 Units, 4,000 or more of hyaluronidase activity.

The super fast-acting insulin compositions provided herein can achieve prandial (e.g. 0-4 hours post administration) systemic exposure to insulin that is at least or about 5%, 10%, 20%, 30%, 40%, 50%, 60%, 70%, 80%, 90%, 100%, 120%, 140%, 160%, 180%, 200%, 300% or 400% greater than the systemic exposure following parental administration of insulin in the absence of the hyaluronan degrading enzyme. The super fast-acting insulin compositions provided herein can achieve systemic glucose metabolism (i.e., a quantification of the removal of glucose from blood expressed either as a rate (amount/time) or the total amount during a predetermined period of time) that is at least or about 30%, 40%, 50%, 60%, 70%, 80%, 90%, 100%, 120%, 140%, 160%, 180%, 200%, 250%, 300%, 350% or 400% greater than the metabolism of blood glucose following parenteral administration of insulin without a hyaluronan degrading enzyme.

The super fast-acting insulin compositions provided herein optionally include a chelating agent, such as, but not limited to ethylenediaminetetraacetic acid (EDTA) or ethylenediaminetetraacetate. The chelating agent can be provided as a complex with a metal at or about equimolar concentrations therewith, such as the chelating agent complex calcium EDTA. The concentration of calcium EDTA is or is about 0.02 mM, 0.04 mM, 0.06 mM, 0.08 mM, 0.1 mM, 0.2 mM, 0.3 mM, 0.4 mM, 0.5 mM, 0.6 mM, 0.7 mM, 0.8 mM, 0.9 mM, 1 mM, 5 mM, 10 mM, 15 mM or 20 mM.

The super fast-acting insulin compositions herein generally include zinc. The concentration of zinc typically is or is about 0.002 milligrams per 100 units of insulin (mg/100 U), 0.005 mg/100 U, 0.01 mg/100 U, 0.012 mg/100 U, 0.014 mg/100 U, 0.016 mg/100 U, 0.017 mg/100 U, 0.018 mg/100 U, 0.02 mg/100 U, 0.022 mg/100 U, 0.024 mg/100 U, 0.026 mg/100 U, 0.28 mg/100 U, 0.03 mg/100 U, 0.04 mg/100 U, 0.05 mg/100 U, 0.06 mg/100 U, 0.07 mg/100 U, 0.08 mg/100 U or 0.1 mg/100 U. In general, fast-acting insulins are formulated with zinc; the amount used herein can be an amount that retains the same concentration of zinc when combined with the hyaluronan degrading enzyme. Exemplary compositions can contain calcium EDTA and zinc at molar ratios of or about 0.5:1, 1:1, 1.5:1, 2:1, 5:1, 10:1, 20:1, 30:1, 40:1, 50:1, 60:1, 70:1, 80:1, 90:1, 100:1, 300:1 or 1000:1, such as about or 0.010-0.50 mg zinc, such as 0.017 mg zinc per 100 U human insulin, and 0.1 to 50 mM calcium EDTA. Other exemplary super fast-acting insulin compositions contain zinc in a molar ratio of about 1:3 to the fast-acting insulin and calcium EDTA at a molar ratio of about 1:3 to 10:1 to the fast-acting insulin.

The super fast-acting insulin compositions also optionally include a tonicity modifier, such as, but not limited to, an amino acid, polyalcohol, such as glycerol, and/or a salt, such as, sodium chloride. The osmolarity of the composition can be or is about 200 mOsm/kg, 220 mOsm/kg, 240 mOsm/kg, 260 mOsm/kg, 280 mOsm/kg, 300 mOsm/kg, 320 mOsm/kg, 340 mOsm/kg, 360 mOsm/kg, 380 mOsm/kg or 400 mOsm/kg. The pH is suitable for parenteral administration, such as about or 5.5 to 8.5, particularly, 6 to 8, such as, about or is 6, 6.2, 6.4, 6.6, 6.8, 7, 7.2, 7.4, 7.6, 7.8 or 8. The compositions can optionally include a stabilizer for the fast-acting insulin, a stabilizer for the hyaluronan degrading enzyme or both. Stabilizers include, but are not limited to, a detergent, a polyalcohol, a metal, a salt, a cosolvent and/or a protein. Exemplary of such stabilizers is serum albumin and/or polysorbate, at a concentration sufficient to achieve greater stability of the composition and/or a component. Serum albumin can be included at a concentration of or about 0.1 mg/mL, 0.2 mg/mL, 0.3 mg/mL, 0.4 mg/mL, 0.5 mg/mL, 0.6 mg/mL, 0.7 mg/mL, 0.8 mg/mL, 0.9 mg/mL or 1 mg/mL. Polysorbate can be included, for example, at a concentration of or about 0.001%, 0.002%, 0.003%, 0.004%, 0.005%, 0.006%, 0.007%, 0.008%, 0.009%, 0.01%, 0.02%, 0.03%, 0.04%, 0.05%, 0.06%, 0.07%, 0.08%, 0.09% or 0.1%. Other optional ingredients include, for example, an oxygen scavenger, such as ascorbic acid, ascorbate, citric acid, citrate, methionine, which can be at a concentration of 1 mM, 2 mM, 3 mM, 5 mM, 10 mM, or 20 mM, and/or albumin and/or a preservative, such as a compound that contains an aromatic ring, for example, m-cresol or phenol.

The fast-acting insulin can be, for example, monomeric or multimeric, such as dimeric or hexameric. Among the fast-acting insulins are regular insulins, such as, but not limited to, human insulin or pig insulin, such as an insulin with an A chain containing or having a sequence of amino acids set forth in SEQ ID NO:103, and a B chain containing or having a sequence of amino acids set forth in SEQ ID NO:104, or an insulin with an A chain containing or having a sequence of amino acids set forth as amino acid residue positions 88-108 of SEQ ID NO:123 and a B chain containing or having a sequence of amino acids set forth as amino acid residue positions 25-54 of SEQ ID NO:123. The insulin can be a recombinant insulin or can be synthesized or partially-synthesized or can be isolated from a natural source. The insulin can be an insulin analog. Exemplary of insulin analogs is an insulin analog selected from among an insulin with an A chain containing or having a sequence of amino acids set forth in SEQ ID NO:103 and a B chain containing or having a sequence of amino acids set forth in any of SEQ ID NOS: 147-149. In some exemplary super fast-acting insulin compositions, the fast-acting insulin is a fast-acting human insulin. Further, the super fast-acting insulin compositions can contain mixtures of insulins. The mixtures can be fast-acting insulins, or mixtures of a fast-acting insulin and also a slower-acting insulin(s), such as a basal-acting insulin.

Hyaluronan degrading enzymes contained in the compositions and combinations provided herein include, for example, hyaluronidases, such as animal, including human, hyaluronidases, particularly soluble forms thereof. Exemplary hyaluronan degrading enzymes are hyaluronidases, particularly soluble hyaluronidases, such as a PH20, or a truncated form thereof. The PH20 can be, for example, an ovine, bovine or truncated human PH20. Included are those that contain or have a sequence of amino acids set forth in any of SEQ ID NOS:1-39 and 67-96 and truncated forms thereof or allelic variants, species variants or other variants thereof. Truncated human PH20, particularly soluble truncated forms, includes any from among polypeptides having a sequence of amino acids set forth in any of SEQ ID NOS:4-9, or allelic variants and other variants thereof. Variants of the hyaluronidases typically have at least 40%, 50%, 60%, 70%, 80%, 85%, 88%, 90%, 91%, 92%, 93%, 94%, 95%, 96%, 97%, 98%, 99% or greater sequence identity with any of SEQ ID NOS: 1-39 and 67-96, particularly with soluble forms, and retain hyaluronidase activity. The soluble hyaluronidase can be the composition that is rHuPH20.

The hyaluronan degrading enzyme can be a chondroitinase, such as, but not limited to, chondroitin ABC lyase, chondroitin AC lyase and chondroitin C lyase. Exemplary chondroitinases have or contain a sequence of amino acids set forth in any of SEQ ID NOS:98-100, or truncated forms thereof or allelic variants, species variants and other variants thereof. Variants typically have at least 40%, 50%, 60%, 70%, 80%, 85%, 88%, 90%, 91%, 92%, 93%, 94%, 95%, 96%, 97%, 98%, 99% or greater sequence identity with a polypeptide set forth in any of SEQ ID NOS. 98-100 or with a wild-type chondroitinase.

The super fast-acting insulin compositions provided herein can be formulated for multiple dosage administration, for dilution to a desired dose or for single dose administration. Exemplary therapeutically effective amounts of insulin depend upon the insulin in the composition and the subject to whom the composition is administered. Such single dosage amounts include, for example, at or about 0.05 Units, 0.06 Units, 0.07 Units, 0.08 Units, 0.09 Units, 0.1 Units, 0.2 Units, 0.3 Units, 0.4 Units, 0.5 Units, 0.6 Units, 0.7 Units, 0.8 Units, 0.9 Units, 1 Unit, 2 Units, 5 Units, 10 Units, 15 Units, 20 Units, 25 Units, 30 Units, 35 Units, 40 Units, 50 Units or 100 Units. In such compositions, the amount of hyaluronan degrading enzyme can be or is functionally equivalent to at or about 0.3 Units, 0.5 Units, 1 Unit, 2 Units, 3 Units, 4 Units, 5 Units, 10 Units, 20 Units, 30 Units, 40 Units, 50 Units, 100 Units, 150 Units, 200 Units, 250 Units, 300 Units, 350 Units, 400 Units, 450 Units, 500 Units, 600 Units, 700 Units, 800 Units, 900 Units or 1000 Units of hyaluronidase activity.

The super fast-acting insulin compositions can be formulated for delivery by a pump. Provided are closed loop systems for controlling blood glucose levels. The systems are any known to those of skill in the art, but modified by containing the fast-acting insulin and hyaluronan degrading enzyme as described herein and suitable dosing or programming to deliver therapeutic dosages of fast-acting insulin and a hyaluronan degrading enzyme to produce a super fast-acting insulin composition. The closed loop systems can include a reservoir containing a fast-acting insulin and a hyaluronan degrading enzyme, where the hyaluronan degrading enzyme is present in an amount sufficient to render the resulting combination a super fast-acting insulin composition. In another embodiment a closed loop system for controlling blood glucose levels is provided that contains a reservoir containing a fast-acting insulin and a second reservoir containing a hyaluronan degrading enzyme.

The closed loop systems optionally can include one or more of a glucose sensor, a delivery system to deliver the hyaluronan degrading enzyme and fast-acting insulin and software programmed to integrate the pumping and monitoring functions, whereby hyaluronan degrading enzyme and fast-acting insulin are delivered to achieve glycemic control that mimics the glycemic control in a non-diabetic subject. The closed loop systems also can contain in a separate reservoir or mixed with the fast-acting insulin and/or hyaluronan, a slower-acting, such as a basal, insulin. The system also can include any of the optional ingredients noted above. The fast-acting insulin and hyaluronan degrading enzyme can include any of those described above.

In the closed loop system, the reservoir containing the fast-acting insulin can contain a sufficient number of units to maintain glycemic control for at least half of a day, one day or more and can contain at or about 0.1 Units, 0.2 Units, 0.3 Units, 0.4 Units, 0.5 Units, 0.6 Units, 0.7 Units, 0.8 Units, 0.9 Units, 1 Unit, 2 Units, 5 Units, 10 Units, 15 Units, 20 Units, 25 Units, 30 Units, 35 Units, 40 Units, 50 Units, 100 Units, 200 Units, 300 Units, 400 Units, 500 Units, 600 Units, 700 Units, 800 Units, 900 Units, 1000 Units, 2000 Units, 5000 Units, 6000 Units, 7000 Units or more of insulin. The closed loop system can deliver any desired amounts or dose increments of insulin and/or hyaluronan degrading enzyme, such as at or about 0.05 Units, 0.1 Units, 0.2 Units, 0.3 Units, 0.4 Units, 0.5 Units, 0.6 Units, 0.7 Units, 0.8 Units, 0.9 Units, 1 Unit, 2 Units, 5 Units, 10 Units, 15 Units, 20 Units, 25 Units, 30 Units, 35 Units, 40 Units, 50 Units or more of insulin per increment. The reservoir containing the hyaluronan degrading enzyme can contain an amount of hyaluronan degrading enzyme that is functionally equivalent to at or about 1 Unit, 5 Units, 10 Units, 20 Units, 30 Units, 40 Units, 50 Units, 100 Units, 150 Units, 200 Units, 250 Units, 300 Units, 350 Units, 400 Units, 450 Units, 500 Units, 600 Units, 700 Units, 800 Units, 900 Units, 1000 Units, 2,000 Units, 3,000 Units, 4,000 Units, 5000 Units, 6,000 Units, 7,000 Units, 8,000 Units, 9,000 Units, 10,000 Units, 20,000 Units or more hyaluronidase activity, and can deliver the hyaluronan degrading enzyme in individual dose increments of an amount of hyaluronan degrading enzyme that is functionally equivalent to at or about, for example, 0.3 Units. 0.5 Units, 1 Unit, 2 Units, 3 Units, 5 Units, 10 Units, 20 Units, 30 Units, 40 Units, 50 Units, 100 Units, 150 Units or more of hyaluronidase activity.

Also provided are combinations containing a first composition containing from or from about 10 U to or to about 500 U insulin, and a second composition containing sufficient amount of hyaluronan degrading enzyme that, when administered with the insulin, renders the fast-acting insulin a superfast acting insulin. The sufficient amount of hyaluronan degrading enzyme is functionally equivalent to least or about 1 U/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL or 25 U hyaluronidase activity/mL. In some examples, the sufficient amount of hyaluronan degrading enzyme is functionally equivalent to at least or about 35 U hyaluronidase activity/mL. For example, the amount of hyaluronan degrading enzyme in the second composition can be functionally equivalent to or to about 1 U/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL, 25 U/mL, 30 U/mL, 35 U/mL, 37.5 U/mL, 40 U/mL, 50 U/mL, 60 U/mL, 70 U/mL, 80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/ml, 2000 U/mL, 3000 U/mL or 5000 U/mL. In some examples, the amount of fast-acting insulin in the first composition is or is about 10 U/mL, 20 U/mL, 30 U/mL, 40 U/mL, 50 U/mL, 60 U/mL, 70 U/mL, 80 U/mL, 90 U/mL, 100 U/mL, 150 U/mL, 200 U/mL, 250 U/mL, 300 U/mL, 350 U/mL, 400 U/mL, 450 U/ml or 500 U/mL.

Also provided are combinations of a first composition containing a hyaluronan degrading enzyme and a second composition containing a fast-acting insulin. The compositions are formulated for parenteral administration. In some instances, the amount of hyaluronan degrading enzyme is sufficient if mixed with the second composition to render the resulting composition a super fast acting insulin composition. In other instances, the amount of the hyaluronan degrading enzyme is sufficient if administered prior to the administration of the first composition to render the fast-acting insulin composition a super fast-acting insulin composition.

In the combinations provided herein, the fast-acting insulins and hyaluronan degrading enzymes and other components are as described above for the compositions. Kits containing the combinations also are provided. The composition of insulin can be formulated to administer a prandial dosage for a single meal, such as, but not limited to, about 0.001 U/kg, 0.005 U/kg, 0.01 U/kg, 0.02 U/kg, 0.03 U/kg, 0.04 U/kg, 0.05 U/kg, 0.06 U/kg, 0.07 U/kg, 0.08 U/kg, 0.09 U/kg, 0.10 U/kg, 0.11 U/kg, 0.12 U/kg, 0.13 U/kg, 0.14 U/kg, 0.15 U/kg, 0.20 U/kg, 0.25 U/kg, 0.30 U/kg, 0.40 U/kg, 0.50 U/kg, 1 U/kg, 1.5 U/kg, or 2 U/kg. The amount of hyaluronan degrading enzyme is formulated to administer to the subject a prandial dosage for a single meal and, for example, is or is about 0.3 U, 0.5 U, 1 U, 2 U, 3 U, 4 U, 5 U, 10 U, 20 U, 30 U, 40 U, 50 U, 100 U, 150 U, 200 U, 250 U, 300 U, 350 U, 400 U, 450 U, 500 U, 600 U, 700 U, 800 U, 900 U, 1000 U, 2,000 U, 3,000 U, 4,000 U, 5,000 U or more. The compositions in the combination can be formulated for subcutaneous administration.

Provided are methods in which the super fast-acting insulin compositions and combinations provided herein are administered. Typically such administration is parenteral administration, such as intravenous, subcutaneous or via any suitable route. In any of the methods provided herein, the fast-acting insulin and hyaluronan degrading enzyme can be administered separately, intermittently, or together in separate compositions or co-formulated. Also provided are methods for controlling glucose levels in a subject by administering any of the super fast-acting insulin compositions or combinations provided herein. In some instances, the compositions or combinations are administered as a prandial dosage, including such as administered less than or about 20, 10, 5 minutes prior to a meal, to less than or about 10 minutes after a meal or with the meal.

Also provided are methods that involve instructing a patient to administer a fast-acting insulin composition less than or about 20, 10, 5 minutes prior to a meal, to less than or about 30 minutes after a meal, wherein the fast-acting insulin is co-administered with a sufficient amount of hyaluronan-degrading enzyme to render the fast-acting insulin composition a super fast acting composition. The fast-acting insulin and hyaluronan degrading enzyme can be co-formulated or provided separately for co-administration. In such methods, the patient can be instructed to administer the fast-acting insulin composition at or at about the time of ingestion of a meal. In some examples, the instructions are written. In other examples, the instructions are oral.

Provided are methods for controlling blood glucose levels in a subject, by administering to a subject a hyaluronan degrading enzyme and a fast-acting insulin, where the hyaluronan degrading enzyme and fast-acting insulin are administered in sufficient amounts to a) obtain a maximal increase in insulin concentration in the blood that is at least or about 20% to 30% greater than the maximal increase in insulin concentration in the blood obtained after administration of the fast-acting insulin in the same manner in the absence of a hyaluronan degrading enzyme; and/or b) reduce the amount of time taken to reach the maximal insulin concentration in the blood to not more than 80% of the time taken to reach the maximal insulin concentration in the blood when the fast-acting insulin is administered in the same manner in the absence of a hyaluronan degrading enzyme; and/or c) increase the insulin concentration 15 minutes after administration by at least or about 50, 60, 70, 80, 90 or 100 pmol/L.

By virtue of the methods, maximal increase in insulin concentration in the blood is at least or about 20%, 30%, 40%, 50%, 60%, 70%, 80%, 90%, 100%, 120%, 140%, 160%, 180%, 200%, 250%, 300%, 350% or 400% greater than the maximal increase in insulin concentration in the absence of the hyaluronan degrading enzyme. The time taken to reach the maximal insulin concentration in the blood can be reduced no more than 80% of the time taken to reach the maximal insulin concentration in the blood in the absence of the hyaluronan degrading enzyme. For example, the insulin concentration following administration of a 20 U dose of insulin 15 minutes after administration can be increased by at least or about 60 pmol/L, 80 pmol/L, 100 pmol/L, 120 pmol/L, 140 pmol/L, 160 pmol/L, 180 pmol/L, or 200 pmol/L.

In exemplary embodiments, the diabetic subjects have either Type 1 or Type 2 diabetes, and the amount of fast-acting insulin administered to the subject is reduced compared to when the fast-acting insulin is administered in the same manner in the absence of a hyaluronan degrading enzyme. For example, the amount of fast-acting insulin administered to a Type 1 diabetic subject can be reduced by at least or about 5%, 10%, 20%, 30%, 40%, 50%, 60%, or more, and the amount of fast-acting insulin administered to a Type 2 diabetic subject can be reduced by at least or about 5%, 10%, 20%, 25%, 30%, 40%, 50%, 60%, 70%, 80% or more.

Also provided are methods for controlling or preventing weight gain and/or obesity in a diabetic subject, such as weight gain associated with prandial insulin therapy. Typically, this is achieved by administering a hyaluronan degrading enzyme and a fast-acting insulin at a dose that is less than the dose of a fast-acting insulin when administered in the absence of a hyaluronan degrading enzyme. The diabetic subjects can be obese or at risk of obesity, and can have Type 1 diabetes, Type 2 diabetes, gestational diabetes or other diabetes. Exemplary of diabetic subjects are Type 2 diabetic subjects. In one example, controlling or preventing obesity in a diabetic subject is achieved by administering to an obese diabetic subject or a diabetic subject at risk of obesity a therapeutically effective dosage of a fast-acting insulin in combination with hyaluronan degrading enzyme. The composition can be administered at or around mealtime, and a) the amount of hyaluronan degrading enzyme is sufficient to render the administered fast-acting insulin a super fast-acting insulin; and b) the dosage of fast-acting insulin achieves substantially the same degree of prandial glucose clearance within the first 40 minutes following administration as a higher dosage of the same fast-acting insulin administered in the same manner in the absence of the hyaluronan degrading enzyme. The dosage of the fast-acting insulin in the super fast-acting insulin composition, compared to the higher dose of fast-acting insulin, has a reduced tendency to cause post-prandial hypoglycemia and obesity. In exemplary embodiments, the diabetic subjects have Type 2 diabetes, and the amount of fast-acting insulin administered to the subject is reduced compared to when the fast-acting insulin is administered in the same manner in the absence of a hyaluronan degrading enzyme. For example, the amount of fast-acting insulin administered to a Type 2 diabetic subject can be reduced by at least or about 5%, 10%, 15%, 20%, 25%, 30%, 40%, 50%, 60%, 70%, 80% or more.

Also provided are methods for reducing or preventing weight gain associated with prandial insulin therapy by subcutaneously administering to a diabetic subject at risk for weight gain from prandial insulin therapy, at or around mealtime, an insulin composition containing a fast-acting insulin and a hyaluronan degrading enzyme, such that the amount of fast-acting insulin administered to treat postprandial hyperglycemia in the subject is reduced compared to the amount of the same fast-acting insulin required to treat the hyperglycemia when administered in the same manner in the absence of the hyaluronan degrading enzyme. The reduced amount of fast-acting insulin renders the composition containing the hyaluronan degrading enzyme less likely to cause weight gain in the subject. For example, a Type 2 diabetic subject can be administered an insulin composition as described above containing an amount of fast-acting insulin that is at least or about 5%, 10%, 15%, 20%, 25%, 30%, 40%, 50%, 60%, 70% or 80% less than the amount of the same fast-acting insulin required to treat the hyperglycemia when administered in the same manner in the absence of the hyaluronan degrading enzyme. In some instances, the insulin composition is administered in a chronic regimen of prandial insulin therapy.

Provided herein are methods for reducing or preventing weight gain in a diabetic subject by administering to a diabetic subject at risk of weight gain from prandial insulin therapy, a course of subcutaneous prandial insulin therapy over a period of at least thirty days. The prandial insulin dosages administered in the course of the therapy contain a combination of a fast-acting insulin and a hyaluronan degrading enzyme. The amount of hyaluronan degrading enzyme in each dosage is sufficient to render the fast-acting insulin a super fast-acting insulin composition, and the amount of fast-acting insulin contained in the dosage to treat the subject's postprandial hyperglycemia is lower than an amount of the same fast-acting insulin required to treat the hyperglycemia in the absence of the hyaluronan degrading enzyme. Such a course of prandial insulin therapy can result in less weight gain than a similar course of therapy using higher dosages of fast-acting insulin in the absence of hyaluronan degrading enzyme.

Also provided are methods for controlling glucose levels in a subject by administering to the subject a prandial dosage of super fast-acting insulin composition, where:

a) the super fast-acting insulin composition comprises a therapeutically effective amount of a fast-acting insulin and a hyaluronan degrading enzyme;

b) the fast-acting insulin is a regular insulin;

c) the dosage is administered, or recommended for prandial or preprandial administration, closer to mealtime than the same or a greater dosage of the same fast-acting regular insulin administered by the same route of administration in the absence of a hyaluronan degrading enzyme; and d) the dosage of the super fast-acting insulin composition has at least the same therapeutic effect as the fast-acting regular insulin without the hyaluronan degrading enzyme.

The super fast-acting insulin composition for example, is administered, or recommended for administration, less than or about 20 minutes prior to a meal, to less than or about 10 or 20 minutes after a meal. Typically, the dosage of the fast-acting insulin in the super fast-acting insulin composition is less than or equal to the dosage of the fast-acting insulin administered by the same route in the absence of the hyaluronan degrading enzyme.

In practicing any of the methods provided herein, the compositions can be administered via any suitable route and using any suitable device or container, such as via syringe, insulin pen, insulin pump or closed loop system. The compositions or combinations can contain any of the fast-acting insulins and hyaluronan degrading enzymes described above, with any of the additional reagents as described above. The amount insulin in the composition administered to the subject can be a prandial dosage for a single meal and is or is about 0.001 U/kg, 0.005 U/kg, 0.01 U/kg, 0.02 U/kg, 0.05 U/kg to 0.30 U/kg, such as 0.05 U/kg, 0.06 U/kg, 0.07 U/kg, 0.08 U/kg, 0.09 U/kg, 0.10 U/kg, 0.11 U/kg, 0.12 U/kg, 0.13 U/kg, 0.14 U/kg, 0.15 U/kg, 0.20 U/kg, 0.25 U/kg, 0.30 U/kg, 0.40 U/kg, 0.50 U/kg, 1.0 U/kg, 1.5/kg or 2 U/kg. The amount of hyaluronan degrading enzyme administered to the subject is for co-administration (separately, intermittently, or together in separate compositions or co-formulated) with a prandial dosage of fast-acting insulin for a single meal. The amount of hyaluronan degrading enzyme can be or is about 0.3 U, 0.5 U, 1 U, 2 U, 5 U, 10 U, 20 U, 30 U, 40 U, 50 U, 100 U, 150 U, 200 U, 250 U, 300 U, 350 U, 400 U, 450 U, 500 U, 600 U, 700 U, 800 U, 900 U, 1000 U, 2,000 U, 3,000 U, 4,000 Units, 5,000 U or more.

Provided are articles of manufacture containing packaging material and any of the super fast-acting insulin compositions or combinations within the packaging material with optional instructions for administration to a diabetic subject.

The fast-acting insulins, insulins, hyaluronan degrading enzymes and other components include those as described above. In particular, the compositions and combinations provided herein are administered.

BRIEF DESCRIPTION OF THE FIGURES

FIG. 2 depicts the pharmacodynamic profiles of the fast-acting insulin analog, Humalog® insulin, and the fast-acting regular insulin, Humulin® R insulin, when administered subcutaneously with or without co-administration of rHuPH20 using a Hyperinsulinemic-Euglycemic Clamp procedure. The glucose infusion rate that was required to maintain blood glucose levels between 90-110 mg/dL following insulin administration to normal healthy subjects was determined.

DETAILED DESCRIPTION

Figure 1:
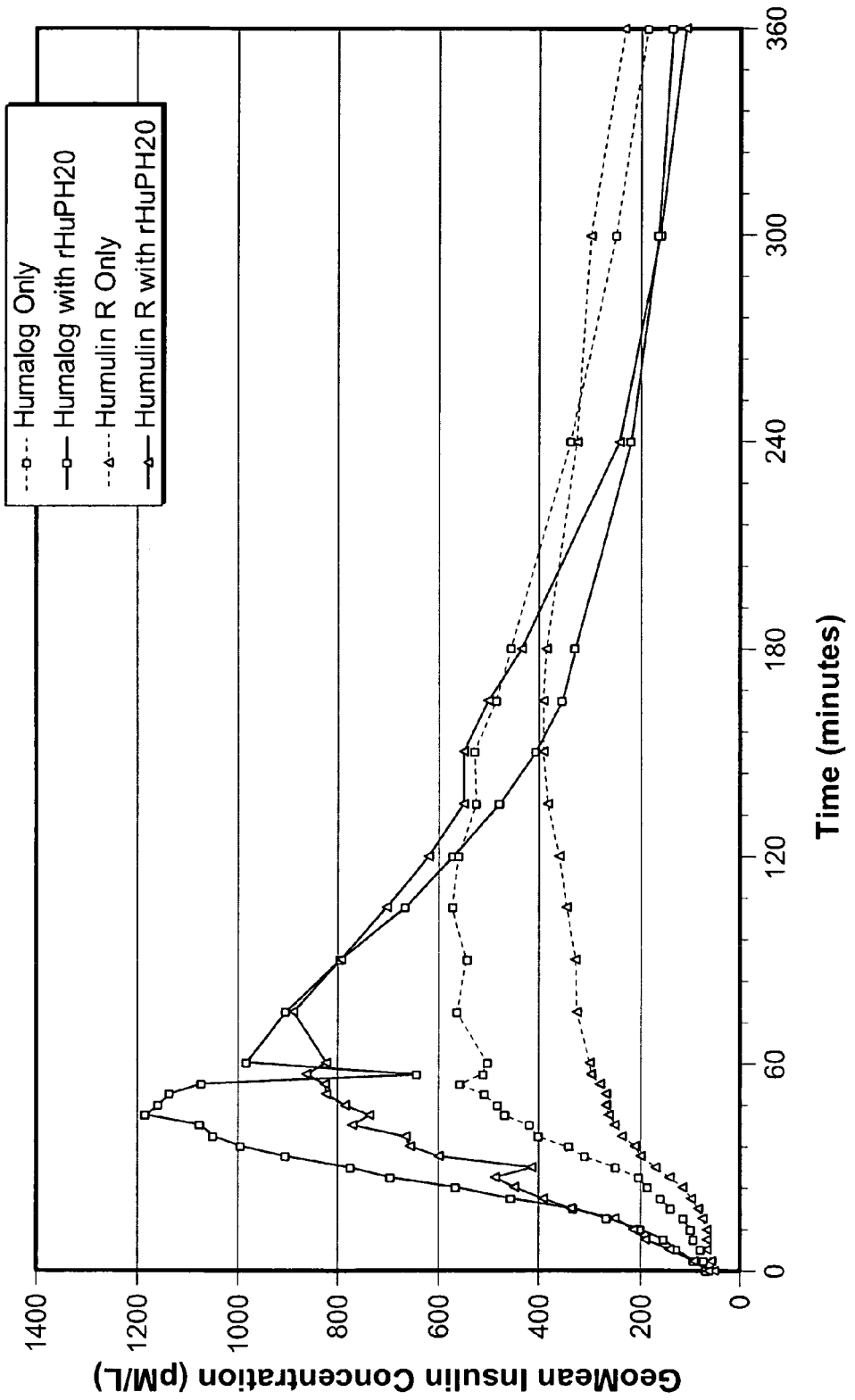
FIG. 1 depicts the pharmacokinetic profiles of the fast-acting insulin analog, Humalog® insulin, and the fast-acting regular insulin, Humulin® R insulin, when administered subcutaneously with or without co-administration of rHuPH20. The plasma insulin concentration at various timepoints following administration to normal healthy subjects using a Hyperinsulinemic-Euglycemic Clamp procedure was determined by radioimmunoassay (RIA).

Outline
A. Definitions
B. "Super fast-acting" insulin
  1. Overview of Insulin, Diabetes and Existing Fast-Acting Insulin Therapies
  2. Pharmacodynamics and Pharmacokinetics of a Super Fast-Acting Insulin Composition
C. Insulin Polypeptides and Formulation
D. Hyaluronan degrading enzymes
  1. Hyaluronidases
    a. Mammalian-type hyaluronidases
    b. Bacterial hyaluronidases
    c. Hyaluronidases from leeches, other parasites and crustaceans
  2. Other hyaluronan degrading enzymes
  3. Soluble hyaluronan degrading enzymes
    a. Soluble Human PH20
    b. Recombinant soluble Human PH20 (rHuPH20)
  4. Glycosylation of hyaluronan degrading enzymes
  5. Modifications of hyaluronan degrading enzymes to improve their pharmacokinetic properties
E. Methods of Producing Nucleic Acids encoding a soluble Hyaluronidase and Polypeptides Thereof
  1. Vectors and Cells
  2. Linker Moieties
  3. Expression
    a. Prokaryotic Cells
    b. Yeast Cells
    c. Insect Cells
    d. Mammalian Cells
    e. Plants
  4. Purification Techniques
F. Preparation, Formulation and Administration of Insulin and Soluble Hyaluronidase Polypeptides
  1. Formulations
    Lyophilized Powders
  2. Dosage and Administration
    Mode of Administration
      a. Syringes
      b. Insulin pen
      c. Insulin pumps and other insulin delivery devices
      d. Closed loop system
G. Methods of Assessing Activity, Bioavailability and Pharmacokinetics
  1. Pharmacokinetics, pharmacodynamics and tolerability
  2. Biological Activity
    a. Insulin
    b. Hyaluronan degrading enzymes
H. Therapeutic Uses
  1. Diabetes Mellitus
    a. Type 1 diabetes
    b. Type 2 diabetes
    c. Gestational diabetes
  2. Insulin therapy for critically ill patients
I. Combination Therapies
J. Articles of Manufacture and Kits
K. Examples A. Definitions Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, "insulin" refers to a hormone, precursor or a synthetic or recombinant analog thereof that acts to increase glucose uptake and storage and/or decrease endogenous glucose production. An exemplary human insulin is translated as a 110 amino acid precursor polypeptide, preproinsulin (SEQ ID NO:101), containing a 24 amino acid signal peptide that directs the protein to the endoplasmic reticulum (ER) wherein the signal sequence is cleaved, resulting in proinsulin (SEQ ID NO:102). Proinsulin is processed further to release the 31 amino acid C— or connecting chain peptide (corresponding to amino acid residues 57 to 87 of the preproinsulin polypeptide set forth in SEQ ID NO:101, and to amino acid residues 33 to 63 of the proinsulin polypeptide set forth in SEQ ID NO:102). The resulting insulin contains a 21 amino acid A-chain (corresponding to amino acid residues 90 to 110 of the preproinsulin polypeptide set forth in SEQ ID NO:101, and to amino acid residues 66 to 86 of the proinsulin polypeptide set forth in SEQ ID NO:102) and a 30 amino acid B-chain (corresponding to amino acid residues 25 to 54 of the preproinsulin polypeptide set forth in SEQ ID NO:101, and to amino acid residues 1 to 30 of the proinsulin polypeptide set forth in SEQ ID NO:102) which are cross-linked by disulfide bonds. A properly cross-linked human insulin contains three disulfide bridges: one between position 7 of the A-chain and position 7 of the B-chain, a second between position 20 of the A-chain and position 19 of the B-chain, and a third between positions 6 and 11 of the A-chain. Reference to insulin includes preproinsulin, proinsulin and insulin polypeptides in single-chain or two-chain forms, truncated forms thereof that have activity, and includes allelic variants and species variants, variants encoded by splice variants, and other variants, such as insulin analogs, including polypeptides that have at least 40%, 45%, 50%, 55%, 65%, 70%, 75%, 80%, 85%, 90%, 95%, 96%, 97%, 98%, 99% or more sequence identity to the precursor polypeptide set forth in SEQ ID NO:101 or the mature form thereof. Exemplary insulin analogs include those set forth in SEQ ID NOS:147-149, 152, and those containing an A-chain set forth in SEQ ID NOS:150, 156, 158, 160, 162 and 164 and/or a B chain set forth in SEQ ID NOS:151, 153-155, 157, 159, 161, 163 and 165.

Exemplary insulin polypeptides are those of mammalian, including human, origin. Exemplary amino acid sequences of insulin of human origin are set forth in SEQ ID NOS: 101-104. Exemplary insulin analogs include those set forth in SEQ ID NOS:147-149, 152, and those containing an A-chain set forth in SEQ ID NOS:150, 156, 158, 160, 162 and 164 and/or a B chain set forth in SEQ ID NOS:151, 153-155, 157, 159, 161, 163 and 165. Insulin polypeptides also include any of non-human origin including, but not limited to, any of the precursor insulin polypeptides set forth in SEQ ID NOS:105-146. Reference to an insulin includes monomeric and multimeric insulins, including hexameric insulins, as well as humanized insulins.

As used herein, "fast-acting insulin" refers to any insulin or fast-acting insulin composition for acute administration to a diabetic subject in response to an actual, perceived, or anticipated hyperglycemic condition in the subject arising at the time of, or within about four hours following, administration of the fast-acting insulin (such as a prandial hyperglycemic condition resulting or anticipated to result from, consumption of a meal), whereby the fast-acting insulin is able to prevent, control or ameliorate the acute hyperglycemic condition. Typically a fast-acting insulin composition exhibits peak insulin levels at or about not more than four hours following subcutaneous administration to a subject. Fast-acting insulin compositions include recombinant insulins and isolated insulins (also referred to as "regular" insulins) such as the insulin sold as Humulin® R, porcine insulins and bovine insulins, as well as insulin analogs designed to be rapid acting by virtue of amino acid changes. Exemplary regular insulin preparations include, but are not limited to, human regular insulins, such as those sold under the trademarks Humulin® R, Novolin® R and Velosulin®, Insulin Human, USP and Insulin Human Injection, USP, as well as acid formulations of insulin, such as, for example, Toronto Insulin, Old Insulin, and Clear Insulin, and regular pig insulins, such as Iletin II® (porcine insulin). Exemplary rapid acting insulin analogs include, for example, insulin lispro (e.g. Humalog® insulin), insulin aspart (e.g. NovoLog® insulin), and insulin glulisine (e.g. Apidra® insulin) the fast-acting insulin composition sold as VIAject® and VIAtab® (see, e.g., U.S. Pat. No. 7,279,457).

While the term "fast-acting insulin" does not encompass "basal-acting insulins," the super fast-acting insulin compositions described herein optionally can include, in addition to a fast-acting insulin, one or more basal-acting insulins.

As used herein, a human insulin refers to an insulin that is synthetic or recombinantly produced based upon the human polypeptide, including allelic variants and analogs thereof.

As used herein, fast-acting human insulins or human fast-acting insulin compositions include any human insulin or composition of a human insulin that is fast-acting, but excludes non-human insulins, such as regular pig insulin.

As used herein, the terms "basal-acting insulins," or "basal insulins" refer to insulins administered to maintain a basal insulin level as part of an overall treatment regimen for treating a chronic condition such diabetes. Typically, a basal-acting insulin is formulated to maintain an approximately steady state insulin level by the controlled release of insulin when administered periodically (e.g. once or twice daily). Basal-acting insulins include crystalline insulins (e.g. NPH and Lente®, protamine insulin, surfen insulin), basal insulin analogs (insulin glargine, HOE 901, NovoSol Basal) and other chemical formulations of insulin (e.g. gum arabic, lecithin or oil suspensions) that retard the absorption rate of regular insulin. As used herein, the basal-acting insulins can include insulins that are typically understood as long-acting (typically reaching a relatively low peak concentration, while having a maximum duration of action over about 20-30 hours) or intermediate-acting (typically causing peak insulin concentrations at about 4-12 hours after administration).

As used herein, "super fast-acting insulin composition" refers to an insulin composition containing a fast-acting insulin and a hyaluronan degrading enzyme (such as a soluble hyaluronidase, including but not limited to, rHuPH20 preparations), such that the insulin composition, over the first forty minutes following parenteral administration to a subject, provides a cumulative systemic insulin exposure in the subject that is greater than the cumulative systemic insulin exposure provided to the subject over the same period after administering the same dosage of the same fast-acting insulin, by the same route, in the absence of the hyaluronan degrading enzyme. The super fast-acting insulin composition as described herein optionally can include a basal-acting insulin.

As used herein, the terms "hyperglycemic condition" or "hyperglycemia" refer to an undesired elevation in blood glucose.

As used herein, the term "hypoglycemic condition" or "hypoglycemia" refers to an undesired drop in blood glucose.

As used herein, "systemic glucose clearance" or "systemic glucose metabolism" refers to the removal of glucose from the blood and can be expressed as either a rate (amount/time) or quantity (amount over a period of time). Systemic glucose clearance can be determined using any suitable method known in the art. For example, systemic glucose clearance can be measured using the Hyperinsulinemic-Euglycemic Clamp Procedure under fasting conditions, such as that exemplified and described herein, where the amount or rate of glucose infused intravenously to maintain constant blood glucose levels, such as, for example, 90-110 mg/dL, is equivalent to the systemic glucose clearance. The difference in the systemic glucose clearance achieved by different insulin compositions, such as the difference in the systemic glucose clearance achieved by administration of a super fast-acting insulin composition versus that achieved by a fast-acting insulin, can therefore be determined using such procedures. The difference in systemic glucose clearance among comparator insulins also can be determined by measuring the relative glucose lowering activity of the comparator insulins at a given point in time after a glucose challenge test. For example, a glucose challenge test (such as, for example, a 75-g oral glucose tolerance test or a standardized test meal formulation, well known to those skilled in the art) can be used to compare different insulin preparations. In such challenge tests, a quantity of glucose or other carbohydrate is administered to a subject, immediately followed by a non-intravenous parenteral administration of the insulin composition. Blood glucose levels (i.e., concentration of glucose in the subject's blood) is then measured at a predetermined time to determine the blood lowering effect of the insulin. In these oral challenge comparisons between various insulin preparations, the time elapsed after which the blood glucose levels are measured must be adequate to allow systemic glucose uptake. The studies described above to determine systemic glucose clearance can be performed using animal models and/or human subjects.

As used herein, glycemic control or "controlling blood glucose levels" refers to the maintenance of blood glucose concentrations at a desired level, typically between 70-130 mg/dL or 90-110 mg/dL.

As used herein, "cumulative systemic insulin exposure" or "cumulative systemic exposure to insulin" refers to the amount of insulin that has been absorbed into the blood following parenteral administration of the insulin. Cumulative systemic exposure to insulin can be determined by calculating the area under the curve for a specific period of time, where the curve is generated by plotting insulin concentration in the blood, serum or plasma as a function of time.

As used herein, a closed loop system is an integrated system for providing continuous glycemic control. Closed loop systems contain a mechanism for measuring blood glucose, a mechanism for delivering one or more compositions, including an insulin composition, and a mechanism for determining the amount of insulin needed to be delivered to achieve glycemic control. Typically, therefore, closed loop systems contain a glucose sensor, an insulin delivery device, such as an insulin pump, and a controller that receives information from the glucose sensor and provides commands to the insulin delivery device. The commands can be generated by software in the controller. The software typically includes an algorithm to determine the amount of insulin required to be delivered to achieve glycemic control, based upon the blood glucose levels detected by the glucose sensor or anticipated by the user.

As used herein, dosing regime refers to the amount of insulin administered and the frequency of administration. The dosing regime is a function of the disease or condition to be treated, and thus can vary.

As used herein, a hyaluronan degrading enzyme refers to an enzyme that catalyzes the cleavage of a hyaluronan polymer (also referred to as hyaluronic acid or HA) into smaller molecular weight fragments. Exemplary of hyaluronan degrading enzymes are hyaluronidases, and particular chondroitinases and lyases that have the ability to depolymerize hyaluronan. Exemplary chondroitinases that are hyaluronan degrading enzymes include, but are not limited to, chondroitin ABC lyase (also known as chondroctinase ABC), chondroitin AC lyase (also known as chondroitin sulfate lyase or chondroitin sulfate eliminase) and chondroitin C lyase. Chondroitin ABC lyase comprises two enzymes, chondroitin-sulfate-ABC endolyase (EC 4.2.2.20) and chondroitin-sulfate-ABC exolyase (EC 4.2.2.21). An exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO:98; Sato et al. (1994) *Appl. Microbiol. Biotechnol.* 41(1):39-46). Exemplary chondroitinase AC enzymes from the bacteria include, but are not limited to, those from *Flavobacterium heparinum Victivallis vadensis*, set forth in SEQ ID NO:99, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133).

As used herein, hyaluronidase refers to a class of hyaluronan degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include, hyaluronidases from cows (SEQ ID NOS:10, 11, 64 and BH55 (U.S. Pat. Nos. 5,747,027 and 5,827,721), yellow jacket wasp (SEQ ID NOS: 12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), sheep (SEQ ID NOS:26, 27, 63 and 65), orangutan (SEQ ID NO:28), cynomolgus monkey (SEQ ID NO:29), guinea pig (SEQ ID NO:30), *Arthrobacter* sp. (strain FB24) (SEQ ID NO:67), *Bdellovibrio bacteriovorus* (SEQ ID NO:68), *Propionibacterium* acnes (SEQ ID NO:69), *Streptococcus agalactiae* ((SEQ ID NO:70); 18RS21 (SEQ ID NO:71); serotype Ia (SEQ ID NO:72); serotype III (SEQ ID NO:73), *Staphylococcus aureus* (strain COL) (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81), *Streptococcus pneumoniae* ((SEQ ID NO:82); strain ATCC BAA-255/R6 (SEQ ID NO:83); serotype 2, strain D39/NCTC 7466 (SEQ ID NO:84), *Streptococcus pyogenes* (serotype M1) (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92); *Streptococcus suis* (SEQ ID NOS:93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y.(1970) *Biochim. Biophys. Acta* 198:607). Hyaluronidases also include those of human origin. Exemplary human hyaluronidases include HYAL1 (SEQ ID NO:36), HYAL2 (SEQ ID NO:37), HYAL3 (SEQ ID NO:38), HYAL4 (SEQ ID NO:39), and PH20 (SEQ ID NO:1). Also included amongst hyaluronidases are soluble hyaluronidases, including, ovine and bovine PH20, soluble human PH20 and soluble rHuPH20. Examples of commercially available bovine or ovine soluble hyaluronidases Vitrase® (ovine hyaluronidase) and Amphadase® (bovine hyaluronidase).

Reference to hyaluronan degrading enzymes includes precursor hyaluronan degrading enzyme polypeptides and mature hyaluronan degrading enzyme polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NOS: 1 and 10-48, 63-65, 67-100, or the mature form thereof. For example, reference to hyaluronan degrading enzyme also includes the human PH20 precursor polypeptide variants set forth in SEQ ID NOS:50-51. Hyaluronan degrading enzymes also include those that contain chemical or posttranslational modifications and those that do not contain chemical or post-translational modifications. Such modifications include, but are not limited to, pegylation, albumination, glycosylation, farnesylation, carboxylation, hydroxylation, phosphorylation, and other polypeptide modifications known in the art.

As used herein, a soluble hyaluronidase refers to a polypeptide characterized by its solubility under physiologic conditions. Soluble hyaluronidases can be distinguished, for example, by its partitioning into the aqueous phase of a Triton X-114 solution warmed to 37° C. (Bordier et al., (1981) J. Biol. Chem., 256:1604-7). Membrane-anchored, such as lipid anchored hyaluronidases, will partition into the detergent rich phase, but will partition into the detergent-poor or aqueous phase following treatment with Phospholipase-C. Included among soluble hyaluronidases are membrane anchored hyaluronidases in which one or more regions associated with anchoring of the hyaluronidase to the membrane has been removed or modified, where the soluble form retains hyaluronidase activity. Soluble hyaluronidases include recombinant soluble hyaluronidases and those contained in or purified from natural sources, such as, for example, testes extracts from sheep or cows. Exemplary of such soluble hyaluronidases are soluble human PH20. Other soluble hyaluronidases include ovine (SEQ ID NOS:27, 63, 65) and bovine (SEQ ID NOS:11, 64) PH20.

As used herein, soluble human PH20 or sHuPH20 include mature polypeptides lacking all or a portion of the glycosylphospatidylinositol (GPI) attachment site at the C-terminus such that upon expression, the polypeptides are soluble. Exemplary sHuPH20 polypeptides include mature polypeptides having an amino acid sequence set forth in any one of SEQ ID NOS:4-9 and 47-48. The precursor polypeptides for such exemplary sHuPH20 polypeptides include a signal sequence. Exemplary of the precursors are those set forth in SEQ ID NOS:3 and 40-46, each of which contains a 35 amino acid signal sequence at amino acid positions 1-35. Soluble HuPH20 polypeptides also include those degraded during or after the production and purification methods described herein.

As used herein, soluble recombinant human PH20 (rHuPH20) refers to a soluble form of human PH20 that is recombinantly expressed in Chinese Hamster Ovary (CHO) cells. Soluble rHuPH20 is encoded by nucleic acid that includes the signal sequence and is set forth in SEQ ID NO:49. Also included are DNA molecules that are allelic variants thereof and other soluble variants. The nucleic acid encoding soluble rHuPH20 is expressed in CHO cells which secrete the mature polypeptide. As produced in the culture medium, there is heterogeneity at the C-terminus so that the product includes a mixture of species that can include any one or more of SEQ ID NOS. 4-9 in various abundance. Corresponding allelic variants and other variants also are included, including those corresponding to the precursor human PH20 polypeptides set forth in SEQ ID NOS:50-51. Other variants can have 60%, 70%, 80%, 85%, 90%, 91%, 92%, 93%, 94%, 95%, 96%, 97%, 98%, 99% or more sequence identity with any of SEQ ID NOS:4-9 and 47-48 as long they retain a hyaluronidase activity and are soluble.

As used herein, activity refers to a functional activity or activities of a polypeptide or portion thereof associated with a full-length (complete) protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, hyaluronidase activity refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as soluble rHuPH20, are known in the art and described herein. Exemplary assays include the microturbidity assay described below (see e.g. Example 3) that measures cleavage of hyaluronic acid by hyaluronidase indirectly by detecting the insoluble precipitate formed when the uncleaved hyaluronic acid binds with serum albumin. Reference Standards can be used, for example, to generate a standard curve to determine the activity in Units of the hyaluronidase being tested.

As used herein, "functionally equivalent amount" or grammatical variations thereof, with reference to a hyaluronan degrading enzyme, refers to the amount of hyaluronan degrading enzyme that achieves the same effect as an amount (such as a known number of Units of hyaluronidase activity) of a reference enzyme, such as a hyaluronidase. For example, the activity of any hyaluronan degrading enzyme can be compared to the activity of rHuPH20 to determine the functionally equivalent amount of a hyaluronan degrading enzyme that would achieve the same effect as a known amount of rHuPH20. For example, the ability of a hyaluronan degrading enzyme to act as a spreading or diffusing agent can be assessed by injecting it into the lateral skin of mice with trypan blue (see e.g. U.S. Pat. Publication No. 20050260186), and the amount of hyaluronan degrading enzyme required to achieve the same amount of diffusion as, for example, 100 units of a Hyaluronidase Reference Standard, can be determined. The amount of hyaluronan degrading enzyme required is, therefore, functionally equivalent to 100 units. In another example, the ability of a hyaluronan degrading enzyme to increase the level and rate of absorption of a co-administered insulin can be assessed in human subjects, such as described below in Example 1, and the amount of hyaluronan degrading enzyme required to achieve the same increase in the level and rate of absorption of insulin as, for example, the administered quantity of rHuPH20, can be determined (such as by assessing the maximum insulin concentration in the blood ($C_{max}$) the time required to achieve maximum insulin concentration in the blood ($t_{max}$) and the cumulative systemic insulin exposure over e given period of time (AUC).

As used herein, the residues of naturally occurring α-amino acids are the residues of those 20 α-amino acids found in nature which are incorporated into protein by the specific recognition of the charged tRNA molecule with its cognate mRNA codon in humans.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to two amino acids in length, and less than or equal to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH$_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |

TABLE 1-continued

Table of Correspondence

| SYMBOL | | |
|---|---|---|
| 1-Letter | 3-Letter | AMINO ACID |
| D | Asp | aspartic acid |
| N | Asn | asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH.

As used herein, "naturally occurring amino acids" refer to the 20 L-amino acids that occur in polypeptides.

As used herein, "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carillo, H. & Lipton, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I): 387 (1984)), BLASTP, BLASTN, FASTA (Atschul, S.F., et al., *J Molec Biol* 215:403 (1990)); Guide to Huge Computers, Martin J. Bishop, ed., Academic Press, San Diego, 1994, and Carillo et al. (1988) SIAM J *Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman (1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., ATLAS OF PROTEIN SEQUENCE AND STRUCTURE, National Biomedical Research Foundation, pp. 353-358(1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)—PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations in proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of enzyme proteins having less that about 30% (by dry weight) of non-enzyme proteins (also referred to herein as a contaminating protein), generally less than about 20% of non-enzyme proteins or 10% of non-enzyme proteins or less that about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight) 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means by using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, operably or operatively linked when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein, the term assessing is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomasie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity), a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving components of the ECM.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a super fast-acting insulin composition provided herein.

As used herein, a pharmaceutically effective agent, includes any therapeutic agent or bioactive agents, including, but not limited to, for example, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein, a therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject exhibiting symptoms of a disease or disorder.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, a therapeutically effective insulin dosage is the amount of insulin required or sufficient to achieve glycemic control. This amount can be determined empirically, such as by glucose or meal challenge. The compositions provided herein contain a therapeutically effective amount or concentration of insulin so that therapeutically effective dosages are administered.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold. As used throughout this application, the term is intended to encompass a fast-acting insulin composition and hyaluronan degrading enzyme composition contained in the same or separate articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a combination of compositions provided herein and another item for a purpose including, but not limited to, reconstitution, activation, instruments/devices for delivery, administration, diagnosis, and assessment of a biological activity or property. Kits optionally include instructions for use.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The enzymes provided herein are from any source, animal, plant, prokaryotic and fungal. Most enzymes are of animal origin, including mammalian origin.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochemistry* 11:1726).

B. Super Fast-acting Insulin Compositions

Provided herein are super fast-acting insulin combinations and compositions. The super fast-acting insulin compositions are obtained by combining, before, or at the time of administration, a fast-acting insulin and a hyaluronan degrading enzyme. Also provided are methods and uses of the super fast-acting insulin composition to treat the same diseases and conditions for which fast-acting insulins have heretofore been indicated, for example, diabetes mellitus for the control of hyperglycemia and other diseases and conditions. Fast-acting insulins (for example Humalog® insulin lispro and Humulin® R insulin) do not adequately mimic the endogenous insulin spike of the first phase prandial insulin release. It is now discovered that by combining a fast-acting insulin with a hyaluronan degrading enzyme, the methods, compositions and combinations described herein provide a super fast-acting insulin composition that more closely mimics the endogenous (i.e., natural) post-prandial insulin release of a nondiabetic subject.

1. Overview of Insulin, Diabetes and Existing Fast-acting Insulin Therapies

Insulin is a naturally-occurring polypeptide hormone secreted by the pancreas. Insulin is required by the cells of the body to effectively take up and use glucose from the blood. Glucose is the predominant energy substrate to carry out cellular functions. In addition to being the primary modulator of carbohydrate homeostasis, insulin has effects on fat metabolism. It can change the ability of the liver and adipose tissue, among others, to release fat stores. Insulin has various pharmacodynamic effects throughout the body, including but not limited to increase in lipid synthesis, reduction in lipid breakdown, increase in protein synthesis, regulation of key enzymes and processes in glucose metabolism (including glucose uptake stimulation, glucose oxidation stimulation, increased glycogen synthesis and reduced glycogen breakdown).

Although insulin is secreted basally, usually in the range of 0.5 to 1.0 unit per hour, its levels are increased after a meal.

After a meal, the pancreas secretes a bolus of insulin in response to a rise in glucose. Insulin stimulates the uptake of glucose into cells, and signals the liver to reduce glucose production; this results in a return of blood glucose to normal levels. In normal adults, there are two phases of insulin release in response to a meal. The early phase is a spike of insulin release that occurs within 2-15 minutes of eating. The late phase release extends about 2 hours. The early phase is responsible for shutting down hepatic glucose production, thereby reducing blood glucose levels and sensitizing or signaling peripheral tissues to increase glucose uptake. In muscle, large amounts of glucose are stored as glycogen. Some of the glycogen is broken down into lactate, which circulates to the liver and can be converted back into glucose and stored as glycogen. Between meals the liver breaks down these glycogen stores to provide glucose to the brain and other tissues.

Diabetes results in chronic hyperglycemia due to the inability or reduced ability of the pancreas to produce adequate amounts of insulin or due to the inability or reduced ability of cells to synthesize and/or release the insulin required. In diabetics, the effectiveness of the above described first-phase response is decreased or absent, leading to elevated postprandial glucose levels. For example, blood glucose area under the curve (AUC) during the first four postprandial hours (i.e. first four hours after eating), is 2.5 to 3.0 times greater in diabetics than in non-diabetics. Postprandial glucose excursions contribute to overall hyperglycemia and elevated HbA1c levels, and these excursions are the primary contributors to HbA1c elevations seen in early stages of Type 2 diabetes.

Many diabetic patients require treatment with insulin when the pancreas produces inadequate amounts of insulin, or cannot use the insulin it produces, to maintain adequate glycemic control. Insulin has been administered as a therapeutic to treat patients having diabetes, including, for example, type 1 diabetes, type 2 diabetes and gestational diabetes, in order to mimic the endogenous insulin response that occurs in normal individuals. Insulin also has been administered to critically ill patients with hyperglycemia to control blood glucose levels. Different sources of insulins are used depending on the patient need. Commercial insulin preparations can be classified depending on their duration of activity (see e.g., DeFelippis et al. (2002) *Insulin Chemistry and Pharmacokinetics. In Ellenberg and Rifkin's Diabetes* Mellitus (pp. 481-500) McGraw-Hill Professional). For example, insulin is provided in fast-acting formulations, as well as intermediate- or long-acting formulations, the latter two classifications being referred to herein as basal-acting insulins. The fast-acting forms have a rapid onset, typically exhibiting peak insulin levels in 2-3 hours or less, and no more than four hours. Hence, fast-acting forms of insulin are used in prandial glucose regulation. Other forms of insulin include intermediate-acting, which reach peak insulin concentration at approximately 4-12 hours following subcutaneous administration, and long-acting insulins that reach a relatively modest peak and have a maximum duration of action of 20-30 hours. The intermediate- and long-acting forms are often composed of amorphous and/or crystalline insulin preparations, and are used predominantly in basal therapies.

The goal of prandial administration of fast-acting insulin compositions is to attain a stable blood glucose level over time by parenteral administration of the fast-acting insulin before, during or soon after mealtime. In this way, blood levels of insulin are temporarily elevated to (a) shut down hepatic glucose production and (b) increase glucose uptake; thus maintaining glycemic control during the elevation in blood glucose associated with meal digestion.

Recombinant human insulin (e.g., Humulin® R insulin) is used for self administration by injection prior to meal time. Unfortunately, recombinant human insulin must be dosed by injection approximately one half hour or more prior to meal time in order to insure that a rise in blood glucose does not occur unopposed by exogenous insulin levels. One of the reasons for the slow absorption of recombinant human insulin is because insulin forms hexameric complexes in the presence of zinc ions both in vivo and in vitro. Such hexameric zinc-containing complexes are more stable than monomeric insulin lacking zinc. Upon subcutaneous injection, these insulin hexamers must dissociate into smaller dimers or monomers before they can be absorbed through capillary beds and pass into the systemic circulation. The dissociation of hexamers to dimers and monomers is concentration-dependent, occurring only at lower concentrations as the insulin diffuses from the injection site. Thus, a local insulin depot exists at the injection site following subcutaneous administration of insulin, providing an initial high concentration of hexameric insulin at the site of injection that can not be absorbed until the insulin concentration decreases (Soeborg et al., (2009) Eur. J. Pharm. Sci. 36:78-90). As the insulin slowly diffuses from the injection site, the insulin concentration lowers as the distance from the injection site increases, resulting in dissociation of the hexamers and absorption of the insulin monomers and dimers. Thus, although dispersal of hexameric insulin complexes occurs naturally in the body, it can take some time to occur, delaying the systemic availability of insulin. Further, because of this concentration-dependent absorption, higher insulin concentrations and higher doses and are absorbed more slowly (Soeborg et al., (2009) Eur. J. Pharm. Sci. 36:78-90).

Since insulin in monomeric form is absorbed more rapidly, while insulins in the hexameric state are more stable, fast-acting analog forms of insulin have been developed that exhibit a faster dissociation from hexameric to monomeric upon subcutaneous administration. Such insulins are modified, such as by amino acid change, to increase the dissociation rate, thereby imparting more rapid pharmacodynamic activity upon injection. As described in Section C, fast-acting analog forms of insulin include but are not limited to, insulin glulisine, insulin aspart, and insulin lispro.

Fast-acting forms of insulins, including fast-acting analogs, have a delay in absorption and action, and therefore do not approximate endogenous insulin that has a early phase that occurs about 10 minutes after eating. Thus, such formulations do not act quickly enough to shut off hepatic glucose production that occurs shortly after this first phase of insulin release. For this reason, even the fast-acting insulin analog preparations must be given in advance of meals in order to achieve any chance of desired glycemic control. Although it is easier to estimate time of eating within 15 minutes than within 30-60 minutes required for regular insulin, there is a risk that a patient may eat too early or too late to provide the best blood glucose control.

Further, one of the main side effects of treatment with any insulin therapy, including fast-acting insulin therapies, is hypoglycemia. Hypoglycemia is defined as low blood glucose and is associated with a variety of morbidities that may range from hunger to more bothersome symptoms such as tremor, sweating, confusion or all the way to seizure, coma and death. Hypoglycemia can occur from failure to eat enough, skipping meals, exercising more then usual or taking too much insulin or using an prandial insulin preparation that has an inappropriately long duration of exposure and action.

For example, since many fast-acting insulin therapies must be given before a meal, there is a risk that a patient may forego or skip the meal, leading to hypoglycemia. Additionally, upon administration of a fast-acting insulin, serum insulin levels and insulin action (measured, for example, as glucose infusion rate (GIR)) typically remain elevated after the prandial glucose load has abated, threatening hypoglycemia. Attempts to better control peak glucose loads by increasing insulin dose further increases this danger. Also, because postprandial hypoglycemia is a common result of insulin therapy, it often causes or necessitates that patients eat snacks between meals. This contributes to the weight gain and obesity often associated with insulin therapies.

2. Pharmacodynamics and Pharmacokinetics of a Super Fast-acting Insulin Composition It is discovered herein that the combination of a fact-acting insulin and a hyaluronan degrading enzyme results in an increased absorption of the fast-acting insulin, resulting in a more rapid rise in serum insulin concentration (i.e. more rapid rate of absorption) and pharmacological action. Hence, the combination of a fast-acting insulin and a hyaluronan degrading enzyme results in a super fast-acting insulin composition capable of effecting a rapid rise in blood glucose following parenteral (i.e., non intravenous) bolus administration (such as for example parenteral administration via subcutaneous (SC), intramuscular (IM), intraperitoneal (IP), or intradermal (ID) routes of administration.

While not being bound by any theory, the combination of a fact-acting insulin and a hyaluronan degrading enzyme can result in increased absorption of the fast-acting insulin, compared to when the insulin is administered alone, due to a change in the mechanism of dispersion following subcutaneous administration. Typically, the presence of high molecular weight hyaluronan provides a barrier to the flow of bulk fluid following subcutaneous injection of insulin alone. Thus, as discussed above, the insulin is dispersed from the site of injection by diffusion-mediated mechanisms. As the insulin disperses from the site of injection, the concentration decreases, facilitating dissociation of insulin hexamers to monomers and dimers, which are small enough to be absorbed through the capillary beds. Thus, to be absorbed following subcutaneous injection, the insulin must first slowly disperse from the site of injection to create the sufficiently low insulin concentrations to facilitate dissociation and, therefore, absorption. However, when the insulin is co-administered with a hyaluronan-degrading enzyme, such as, for example, a soluble hyaluronidase, the hyaluronan is degraded by the hyaluronan-degrading enzyme, enabling the flow of bulk fluid, which is rapidly dispersed proportional to the pressure gradient (or hydraulic conductivity). At physiologic pressure, for example, a soluble hyaluronidase such as rHuPH20 generates an approximate 20-fold increase in hydraulic conductance. Thus, when co-administered with a hyaluronan-degrading enzyme, the insulin is rapidly dispersed in a convection-mediated manner following degradation of the hyaluronan barrier. This rapid absorption of insulin when co-administered subcutaneously with hyaluronan degrading enzyme can result in improved pharmacokinetic and pharmacodynamic properties of the insulin compared to when the insulin is administered alone.

For example, as provided herein, the super fast-acting insulin composition is absorbed faster as demonstrated by a reduction of $t_{max}$, and increased $C_{max}$ and cumulative systemic insulin exposure that is especially pronounced over the first 40 minutes. This improved pharmacokinetic profile is reflected in a shortened onset and duration of insulin effect. This can be exemplified by pharmacodynamic measures, such as by glucose infusion rates in euglycemic clamp experiments such as is described in Example 1. Thus, a super fast-acting insulin composition is more rapidly absorbed than the corresponding fast-acting insulin. Interestingly, as set forth in FIGS. 1 and 2, the super fast-acting insulin compositions containing a hyaluronan degrading enzyme exhibit an accelerated absorption of both fast-acting regular insulins and fast-acting insulin analogs resulting in similar pharmacodynamic (PD) and pharmacokinetic (PK) profiles, even though fast-acting insulin analog is substantially faster than the fast-acting regular insulin without the hyaluronan degrading enzyme. Thus, super fast-acting insulin compositions exhibit similar pharmacodynamic (PD) and pharmacokinetic (PK) profiles, regardless of whether a fast-acting insulin analog or fast-acting regular insulin is included in the composition. This similarity is particularly striking in the first 40 to 60 minutes following administration (see e.g., FIGS. 1 and 2). Hence, an additional advantage of the super fast-acting insulin composition is the ability to achieve comparable pharmacokinetic and pharmacodynamic profiles in the first 40 to 60 minutes following administration, Without regard to whether the fast-acting insulin is a fast-acting regular insulin (e.g., Humulin® R insulin) or a fast-acting analog (such as Humalog® insulin lispro, Novalog® insulin aspart or Apidra® insulin glulisine). In some instances, such as where the fast-acting insulin in the super fast-acting insulin composition is a rapid acting insulin analog, rather than a regular insulin, the absorption of the fast acting insulin when administered with the hyaluronan degrading enzyme (i.e. as a super fast acting insulin composition) is faster than the fastest of the fast acting insulins alone. This can manifest itself as, for example, decreased $t_{max}$ and increased cumulative systemic insulin exposure, particularly over the first 40 minutes.

The pharmacokinetics of the super fast-acting insulin composition differs from the corresponding fast-acting insulin in several important respects. First, the profile of insulin blood concentration as a function of time is shifted to one of higher concentrations at earlier times (see for example, FIG. 1). This rate of appearance of insulin into the systemic circulation is described as the absorption rate, as distinguished from the rate of removal from the systemic circulation, which is described as the clearance rate. Super fast-acting insulin compositions have a greater absorption rate, resulting in greater early exposure, than the corresponding fast-acting insulin. Moreover, because the hyaluronan degrading enzyme is transiently and locally acting at the site of administration, the clearance rate of the super fast-acting insulin composition and its potency once in the systemic circulation are not materially different from the corresponding fast-acting insulin. By increasing the absorption rate while maintaining the same clearance rate, the maximum blood concentration of insulin ($C_{max}$) also is increased for a super fast-acting insulin composition relative to the corresponding fast-acting insulin. Thus, the same total quantity of systemically available insulin is distributed differently as a function of time for a super fast-acting insulin composition relative to the corresponding fast-acting insulin, such that, following parenteral administration of a super fast-acting insulin composition, a greater fraction of the cumulative systemic insulin exposure occurs over earlier time points and a smaller fraction of the cumulative systemic insulin exposure occurs over later time points, as compared to an insulin that is merely fast-acting. This shift in the absorption rate enables the super fast-acting insulin composition to more closely mimic the body's endogenous insulin response to the spike in blood glucose levels that occurs after consumption of a meal.

A second and independent pharmacokinetic parameter, the fraction of the administered dose that reaches the systemic circulation, also can differ from the super fast-acting insulin composition relative to its corresponding fast-acting insulin. For certain fast-acting insulins, the vast majority of the administered dose is systemically bioavailable, and hence there may only be an incremental increase for the corresponding super fast-acting composition. However for other fast-acting insulins, such as regular insulin (for example Humulin® R insulin), the increase in bioavailability can be significant. The relative bioavailability of a super fast-acting insulin composition as described herein to its corresponding fast-acting insulin is described by the ratio of the total systemic exposure ($AUC_{0\text{-}infinity}$) of the two compositions following identical non-IV parenteral administrations.

A further important aspect of the super fast-acting insulin compositions concerns the ability to achieve improvement in pharmacodynamic parameters that measure the physiological response to the systemically available insulin. Because the super fast-acting insulin compositions described herein have the same pharmacological potency upon reaching the systemic circulation as the corresponding fast-acting insulin, the improved pharmacokinetic profiles offered by the super fast-acting insulin compositions (as discussed above) result in beneficial changes in pharmacodynamic parameters that measure the physiological response to the systemically available insulin. For example, the glucose infusion rate (GIR) measured when insulin is administered to subjects in a euglycemic clamp procedure represents a pharmacodynamic parameter as it measures the rate of intravenous glucose administration as a function of time required to maintain a steady target blood glucose concentration. By virtue of the pharmacokinetic advantage of greater absorption rate achieved by a super fast-acting insulin composition compared to the corresponding fast-acting insulin, the super fast-acting insulin composition is able to shift the GIR profile (a measure of the physiological response to the insulin) toward greater infusion rates (i.e., greater physiological response) at earlier times. For those super fast-acting insulin compositions where there also is a meaningful increase in relative systemic bioavailability, a further increase in GIR response can be observed, although the total GIR is a function of both the distribution of insulin levels as a function of time and of the systemic dose administered.

The pharmacokinetic and pharmacodynamic advantages afforded by the super fast-acting insulin compositions described herein lead to a number of important uses. First, by shifting the PK and PD responses to earlier times, a more natural insulin response for the super fast-acting composition can be produced to control postprandial glucose levels than is possible with the corresponding fast-acting insulin composition alone. The body's natural insulin response includes both (a) an initial burst of insulin within the first 10-15 minutes signaling shutdown of the hepatic glucose release and providing minimum glucose blood concentrations between meals; and (b) a total insulin exposure over about 2 hours, which is matched to the carbohydrate composition of the meal by adjusting insulin release into the systemic circulation as a function of glucose levels through a complex interplay of hormonal responses, including both beta cell responses to systemic metabolite (predominately glucose) levels and incretin hormones which potentiate insulin secretion when the intestinal tract senses the presence of nutrient materials. By having a greater fraction of the systemically available insulin exposure occur over the first 10-15 minutes, the super fast-acting insulin composition is better able to signal the shutdown of the hepatic glucose release (like the body's endogenous prandial insulin response) as compared to the corresponding fast-acting insulin composition. Moreover, the super fast-acting insulin compositions described herein also are better able to mimic the natural control of post-prandial glucose, by having a greater fraction of the systemically available insulin exposure over the first 2 hours and a corresponding reduction in the insulin exposure after 2 hours. Elevated insulin levels occurring more than 2 hours after administration can result in an increased glucose metabolism when postprandial glucose absorption is complete, a situation that leads to low blood glucose levels or hypoglycemia. Additionally, because the super fast-acting insulin compositions have an onset of action similar to the natural insulin response, these compositions can be administered at mealtime, while many fast-acting insulin compositions (for example, Humulin® R insulin) are administered 30-60 minutes prior to a meal, which introduces a risk of hypoglycemia if the subject delays or skips the intended meal. Thus, through the combination of increased insulin exposure over the first 15 minutes, and decreased insulin exposure after 2 hours, super fast-acting insulin compositions are better able to control postprandial glucose levels than the corresponding fast-acting insulin compositions.

Fast-acting insulins typically are administered over a wide range of doses as determined by the physician or other qualified healthcare provider depending on many factors including the actual glucose levels, the subject, the type of diabetes and the composition of the meal. Typically, such fast-acting insulin doses can be in the range of between 0.05 Units/kg to 2 Units/kg. Due to their pharmacokinetics and pharmacodynamics, super fast-acting insulin compositions can be administered at lower doses compared to the fast-acting insulin administered in the absence of a hyaluronan degrading enzyme. The degree to which the amount of a fast-acting insulin can be lowered by administering it as a super fast-acting insulin composition varies, depending on, for example, the type of diabetes the patient has. Typically, the reduction in the amount of fast-acting insulin administered to Type 2 diabetic patients when administered as a super fast-acting insulin composition is greater than the reduction in the amount of fast-acting insulin administered to Type 1 diabetic patients when administered as a super fast-acting insulin composition. For example, in instances where a Type 1 diabetic patient and Type 2 diabetic patient are each administered 0.20 U/kg of fast-acting insulin to control postprandial glucose levels, the Type 1 diabetic patient can be administered 0.15 U/kg of fast-acting insulin in a super fast-acting insulin composition to achieve the same or better glycemic control, and the Type 2 diabetic patient can be administered 0.10 U/kg fast-acting insulin in a super fast-acting insulin composition to achieve the same or better glycemic control. Thus, in some examples, it is contemplated herein that the amount of a fast-acting insulin that is administered to a Type 2 diabetic patient to achieve glycemic control can be reduced by, for example, 5%, 10%, 15%, 20%, 25%, 30%, 35%, 40%, 45%, 50%, 55%, 60%, 65%, 70%, 75%, 80% or more when administered with a hyaluronan degrading enzyme as a super fast-acting insulin composition compared to the amount required for glycemic control when administered without a hyaluronan degrading enzyme, and that the amount of a fast-acting insulin that is administered to a Type 1 diabetic patient to achieve glycemic control can be reduced by, for example, 5%, 10%, 15%, 20%, 25%, 30%, 35%, 40%, 45%, 50%, 55%, 60%, 65%, 70% or more when administered with a hyaluronan degrading enzyme as a super fast-acting insulin composition compared to the amount required for glycemic control when administered without a hyaluronan degrading enzyme.

While not being bound by any theory, the greater reduction in the fast-acting insulin dose for Type 2 diabetic patients compared to Type 1 diabetic patients when the insulin is administered with a hyaluronan degrading enzyme as a super fast-acting insulin composition is a reflection of the different postprandial glycemic profiles of Type 1 and Type 2 patients, and the ability of the super fast-acting insulin to more closely mimic the natural first phase insulin release in healthy subjects. Type 2 diabetes develops as a result of impaired β cell function, insulin resistance, and/or impaired insulin secretion. These patients lack the early phase insulin release that occurs within minutes of a glucose challenge, such as a meal, but still slowly release insulin over time. In contrast, Type 1 diabetic patients do not produce any insulin and so lack both the first and second phase insulin release, the latter of which is sustained in healthy subjects until glycemic control is achieved. Thus, because Type 2 diabetics generally only require insulin therapy primarily to address post-prandial hyperglycemia, a problem to be overcome in prandial insulin therapy in such diabetics is the occurrence of hypoglycemia. Hypoglycemia can result if the subject's own delayed and/or basal insulin secretion is coupled with the glucose lowering effect of any excess exogenous insulin remaining after the prandial spike has been alleviated. Over time, repeated occurrences of such post-prandial hypoglycemic episodes can contribute to weight gain and obesity. The pharmacokinetics and pharmacodynamics of the fast-acting insulins are such that the dose that is needed to achieve an appropriate concentration of insulin in the blood quickly enough to lower glucose levels immediately following digestion of a meal (i.e. a dose that covers the natural early phase insulin release) is one that results in excess insulin circulating in the blood following digestion and lowering of the postprandial glucose levels. Therefore, Type 2 diabetic patients receive insulin doses that cover more than just the early phase insulin release. The super fast-acting insulin compositions provided herein more closely mimic the endogenous insulin response. Thus, Type 2 diabetics can be administered a super fast-acting insulin composition at a dose that covers only the first phase insulin release, while Type 1 diabetics can be administered a super fast-acting insulin composition at a dose that covers all phases of insulin release.

Thus, another use of the super fast-acting insulin compositions provided herein is to reduce the side-effects of weight gain and obesity associated with fast-acting insulin therapy. The magnitude of this side effect is about or is proportional to the dose of insulin administered. As discussed above, super fast-acting insulin compositions can provide equivalent glycemic control from lower doses of fast-acting insulin as the corresponding fast-acting compositions through, for example, a combination of the greater bioavailability and the greater fraction of cumulative systemic insulin exposure over the first 0.25, 0.5, 0.75, 1, 1.5 or 2 hours following administration. Although Type 1 and Type 2 diabetic patients can experience weight gain as a result of insulin therapy, patients with Type 2 diabetes are at particular risk of weight gain, leading to obesity. Type 2 diabetics lack the first-phase insulin release, but still slowly release insulin over time. As a result, in the early stages of the disease, the Type 2 diabetics' endogenous insulin levels are too low at the initiation of a meal and too high after meal digestion. In the absence of the first-phase insulin release, the liver does not receive the signal to stop making glucose. The liver continues to produce glucose at a time when the body begins to produce new glucose through the digestion of the meal, resulting in hyperglycemia. Between two and three hours after a meal, an untreated diabetic's blood glucose becomes so elevated that the pancreas receives a signal to secrete a large amount of insulin. In a patient with early Type 2 diabetes, the pancreas can still respond and secretes this large amount of insulin. This occurs at the time when digestion is almost over and blood glucose levels should begin to fall. This large amount of insulin has two detrimental effects. First, it puts an undue demand on an already compromised pancreas, which can lead to its more rapid deterioration and eventually render the pancreas unable to produce insulin. Second, too much insulin after digestion can contribute to weight gain, which can further exacerbate the disease condition. When patients with Type 2 diabetes are administered a fast-acting insulin to control postprandial hyperglycemia, as discussed above, an excess of insulin can remain following digestion. Thus, Type 2 diabetic patients receiving insulin therapy can have too much insulin after digestion, which can lead to hypoglycemia and resultant weight gain. Administration of the super-fast acting insulin compositions provided herein to control postprandial hyperglycemia reduces the risk of weight gain and obesity in diabetic patients. The super-fast acting insulin compositions can contain the lower doses of fast-acting insulin.

To achieve glycemic control, the fast-acting insulin in super fast-acting insulin compositions could be administered at 20%, 30%, 40%, 50%, 60%, 70%, 80% or 90% of the level that the fast-acting insulin would have to be administered if the hyaluronan degrading enzyme were not present. Thus, for example, the amount of fast-acting insulin administered in a super fast-acting composition is typically, or is about, 0.05 U/kg, 0.06 U/kg, 0.07 U/kg, 0.08 U/kg, 0.09 U/kg, 1.0 U/kg, 1.1 U/kg, 1.2 U/kg, 1.3 U/kg, 1.4 U/kg, 1.5 U/kg, 1.6 U/kg, 1.7 U/kg, 1.8 U/kg, 1.9 U/kg, or 2.0 U/kg. By virtue of lower doses, the duration of action of such insulins can be lessened to minimize the potential for late hypoglycemia that occurs due to the elevated plasma insulin concentration that extends over several hours. Thus, a faster onset of action of the super fast-acting insulin composition, which more closely mimics the endogenous insulin spike of the first phase prandial insulin release, is expected to provide clinical benefit with regard to better glycemic control and less weight gain in patients with diabetes mellitus.

Further, by affording an increased rate of absorption, super fast-acting insulin compositions as described herein can provide a shorter feedback cycle between the effect of administered insulin and effect on observed glucose levels than the corresponding fast-acting insulin compositions, and therefore are better able to mimic the natural regulation of postprandial glucose levels. Hence, the modified pharmacokinetics of a super fast-acting insulin composition also benefits the performance of the existing 'insulin pump' and continuous glucose monitoring (GCM) technology. By shortening the time between a postprandial insulin bolus injection and a systemic glycemic response, tighter control of glucose levels from repeated smaller subcutaneous injections of insulin with GCM could 'close the loop' on a combined insulin pump/glucose monitoring device (i.e. closed loop system or artificial pancreas).

The super fast-acting insulin compositions, whether provided as a single mixture, or as separate preparations, of fast-acting insulin and hyaluronan degrading enzyme can contain additional ingredients to provide desired physical or chemical properties. For example, an injectable solution can contain one or more tonicity modifiers to provide an approximately isotonic solution, and an aqueous solvent titrated to neutral pH with an acid or base and possibly with a pH buffering component. Fast-acting insulin formulations often include Zn and a phenolic antimicrobial preservative such as m-cresol to structurally stabilize them in a more stable hexameric state. Metal chelators, such as EDTA, can be used to adjust the rate of dissociation of these hexamers, and other divalent metals such as calcium can be present to buffer the chelating capacity. Hyaluronan degrading enzymes often require additional components to provide physical and chemical stability, including but not limited to surfactants, oxygen scavengers, salts, amino acids and polyalcohols.

Super fast-acting insulin compositions can be presented as a kit of two separate containers, one containing a fast-acting insulin composition and another containing hyaluronan degrading enzyme composition, for sequential (in any order) or concurrent coadministration; or as a kit containing a single container containing a mixture of a fast-acting insulin composition and a hyaluronan degrading enzyme composition. If the fast-acting insulin and the hyaluronan degrading enzyme are coadministered, said coadministration can be sequential in any order (for example the hyaluronan degrading enzyme is administered prior to the fast-acting insulin whereby the hyaluronan degrading enzyme degrades the hyaluronan at the injection site prior to administration of the fast-acting insulin); or the coadministration of the fast-acting insulin and the hyaluronan degrading enzyme can be concurrent. The fast-acting insulin composition and the hyaluronan degrading enzyme compositions can be formulated (together or separately) as a solid for injection after reconstitution with an appropriate diluent, as injectable solutions, or as injectable suspensions.

The following sections describe exemplary fast-acting insulins and soluble hyaluronan degrading enzymes used in the super fast-acting insulin compositions provided herein, methods of making them, and using them to treat diseases and conditions for which current fast-acting insulins are used.

C. Insulin Polypeptides and Formulations

Insulin is a polypeptide composed of 51 amino acid residues that is 5808 daltons in molecular weight. It is produced in the beta-cell islets of Langerhans in the pancreas. An exemplary human insulin is translated as a 110 amino acid precursor polypeptide, preproinsulin (SEQ ID NO:101), containing a 24 amino acid signal peptide to ER, the signal sequence is cleaved, resulting in proinsulin (SEQ ID NO:102). The proinsulin molecule is subsequently converted into a mature insulin by actions of proteolytic enzymes, known as prohormone convertases (PC1 and PC2) and by actions of the exoprotease carboxypeptidase E. This results in removal of 4 basic amino acid residues and the remaining 31 amino acid C-peptide or connecting chain (corresponding to amino acid residues 57 to 87 of the preproinsulin polypeptide set forth in SEQ ID NO:101) The resulting insulin contains a 21 amino acid A-chain (corresponding to amino acid residues 66 to 86 of the proinsulin polypeptide set forth in SEQ ID NO:102) and a 30 amino acid B-chain (corresponding to amino acid residues 1 to 30 of the proinsulin polypeptide set forth in SEQ ID NO:102), which are cross-linked by disulfide bonds. Typically, mature insulin contains three disulfide bridges: one between position 7 of the A-chain and position 7 of the B-chain, a second between position 20 of the A-chain and position 19 of the B-chain, and a third between positions 6 and 11 of the A-chain. The sequence of the A chain of a mature insulin is set forth in SEQ ID NO:103 and the sequence of the B-chain is set forth in SEQ ID NO:104.

Reference to insulin includes preproinsulin, proinsulin and insulin polypeptides in single-chain or two-chain forms, truncated forms thereof that have activity, and includes allelic and species variants, variants encoded by splice variants and other variants, such as insulin analogs or other derivatized forms, including polypeptides that have at least 40%, 45%, 50%, 55%, 60%, 65%, 70%, 75%, 80%, 85%, 90%, 95%, 96%, 97%, 98%, 99% or more sequence identity to the precursor polypeptide set forth in SEQ ID NO:101 or the mature form thereof, so long as the insulin binds to the human insulin receptor to initiate a signaling cascade that results in an increase of glucose uptake and storage and/or a decrease of endogenous glucose production. For example, insulins include species variants of insulin. These include, but are not limited to, insulins derived from bovine (set forth in SEQ ID NO:133) and porcine (SEQ ID NO:123). Bovine insulin differs from human insulin at amino acids 8 and 10 of the A chain, and amino acid 30 of the B chain. Porcine insulin only differs from human insulin at amino acid 30 in the B chain where, like the bovine sequence, there is an alanine substitution in place of threonine. Other exemplary species variants of insulin are set forth in any of SEQ ID NOS: 105-146. Also included among variants of insulin are insulin analogs that contain one or more amino acid modifications compared to a human insulin set forth in SEQ ID NO: 103 and 104 (A and B chains). Exemplary insulin analogs (A and B chains), including fast-acting and longer-acting analog forms, are set forth in SEQ ID NOS:147-165, 182-184). For example, insulin analogs include, but are not limited to, glulisine (LysB3, GluB29; set forth in SEQ ID NO:103 (A-chain) and SEQ ID NO:149 (B-chain)), HMR-1 153 (LysB3, IleB28; set forth in SEQ ID NO:103 (A-chain) and SEQ ID NO:182 (B-chain)), HMR-1423 (GlyA21, HisB31, HisB32; set forth in SEQ ID NO:183 (A-chain) and SEQ ID NO:184 (B-chain)), insulin aspart (AspB28; set forth in SEQ ID NO:103 (A-chain) and SEQ ID NO:147 (B-chain)), and insulin lispro (LysB28, ProB29; set forth in SEQ ID NO:103 (A-chain) and SEQ ID NO:148 (B-chain)). In every instance above, the nomenclature of the analogs is based on a description of the amino acid substitution at specific positions on the A or B chain of insulin, numbered from the N-terminus of the chain, in which the remainder of the sequence is that of natural human insulin.

Any of the above insulin polypeptides include those that are produced by the pancreas from any species, such as a human, and also include insulins that are produced synthetically or using recombinant techniques. For example, as described elsewhere herein, insulin can be produced biosynthetically by expressing synthetic genes for A and B chains of insulin, by expressing the entire proinsulin and exposing it to the appropriate enzymatic and chemical methods to generate a mature insulin, or by expressing A and B chains connected by a linker peptide (see e.g., DeFelippis et al. (2002) Insulin Chemistry and Pharmacokinetics. In Ellenberg and Rifkin's Diabetes Mellitus (pp. 481-500) McGraw-Hill Professional).

Insulins also include monomeric and oligomeric forms, such as hexameric forms. Insulin can exist as a monomer as it circulates in the plasma, and it also binds to its receptor while in a monomeric form. Insulin, however, has a propensity to self-associate into dimers, and in the presence of metal ions such as $Zn^{2+}$ can readily associate into higher order structures such as hexamers. There are two symmetrical high affinity binding sites for $Zn^{2+}$, although other weaker zinc-binding sites also have been reported (see e.g., DeFelippis et al. (2002) *Insulin Chemistry and Pharmacokinetics*. In Ellenberg and Rifkin's Diabetes Mellitus (pp. 481-500) McGraw-Hill Professional). Self-association is important for the stability of the molecule to prevent chemical degradation and physical denaturation. Thus, in storage vesicles in pancreatic beta-cells, insulin exists as a hexamer. Upon release into the extracellular space, however, it is believed that the insulin hexamers can experience a change in pH to more neutral conditions and the zinc ion-containing hexamers are diluted, which destabilizes the hexamer. There may be other reasons contributing to the destabilization of the insulin hexamer in the extracellular space. Insulin is thus predominantly found in the blood as a monomer. To take advantage of the stabilizing effects, most commercial formulations of insulin contain zinc ions in sufficient amounts to promote self-association into hexamers. The hexameric structure, however, slows down the absorption rate of these formulations upon subcutaneous administration.

As discussed in Section B, insulin is used as a therapeutic for glycemic control, such as in diabetic patients. There are various types of insulin formulations that exist, depending on whether the insulin is being administered to control glucose for basal therapy, for prandial therapy, or for a combination thereof. Insulin formulations can be provided solely as fast-acting formulations, solely as basal-acting formulations (i.e., intermediate-acting and/or long-acting forms), or as mixtures thereof (see e.g., Table 2). Typically, mixtures contain a fast-acting and an intermediate- or long-acting insulin. For example, fast-acting insulins can be combined with an NPH insulin (an exemplary intermediate-acting insulin as discussed below) in various mixture ratios including 10:90, 20:80, 30:70, 40:60, and 50:50. Such premixed preparations can reduce the number of daily insulin injections by conveniently providing both meal-related and basal insulin requirements in a single formulation. Accordingly, the super fast-acting insulin composition formulations described herein include those that optionally can provide a basal-acting insulin.

Generally, any preparation of insulin includes an insulin polypeptide or variant (i.e. analog) thereof, and differ only in the other substances that make up the formulation. Hence, it is the specifics of the formulation that can influence the duration of action of different insulin types. Examples of substances included in insulin preparations, include, but are not limited to, stabilization agents such as zinc, pH buffer, a tonicity modifier such as glycerin; a preservative/anti-microbial agent such as m-cresol; and protamine or other precipitation or controlled release agent. Further, as provided herein, insulin preparations also can be prepared containing calcium and a metal chelator such as EDTA or EGTA. Any one or more of the above substances can be added to an insulin polypeptide, such as in a super fast-acting insulin composition. The specific components added, and their amounts, influence the type of insulin, its duration of action, its absorption and bioavailability and hence, its application.

For example, most insulin preparations contain a metal ion, such as zinc, in the formulation, which stabilizes the insulin by promoting self-association of the molecule. Self-association into hexameric forms can affect the absorption of insulin upon administration. Hence, the ratio of such stabilizing agents, and the addition of EDTA or EGTA to insulin, permits further modulation and control of the absorption and bioavailability of insulin, for example, by influencing the prevalence of higher order structure present in the polypeptide. Generally, regular insulin preparations that are fast-acting contain zinc in an amount that is or is about 0.01-0.04 mg/100 Units.

Chemical studies have revealed that the solubility of insulin is largely determined by the zinc content and the nature of the buffer in which it is suspended. Hence, some longer-acting basal insulin formulations are prepared by precipitating insulin from an acetate buffer (instead of phosphate) by the addition of zinc. Large crystals of insulin with high zinc content, when collected and resuspended in a solution of sodium acetate-sodium chloride (pH 7.2 to 7.5), are slowly absorbed after subcutaneous injection and exert an action of long duration. This crystal preparation is named extended insulin zinc suspension (ultralente insulin). Other zinc-containing insulin preparations include, for example, semilente insulins (prompt insulin zinc suspensions) and lente insulins (insulin zinc suspensions), which differ predominantly in the zinc concentration used. Zinc-containing insulin preparations also include those that are modified by protamine, such as NPH insulin.

In another example, a precipitation agent, such as protamine, can be added to an insulin polypeptide to generate a microcrystalline suspension. Typically, crystalline insulins have a prolonged duration of action compared to insulins that do not exist in crystalline form. A protamine zinc insulin, when injected subcutaneously in an aqueous suspension, dissolves only slowly at the site of deposition, and the insulin is absorbed at a retarded rate. Protamine zinc suspension insulin has largely been replaced by isophane insulin suspension, also known as NPH insulin. It is a modified protamine zinc insulin suspension that is crystalline. The concentrations of insulin, protamine, and zinc are so arranged that the preparation has an onset and a duration of action intermediate between those of regular insulin and protamine zinc insulin suspension.

Further, pH differences in the preparations also influence the type and property of insulin. The original regular insulin preparations were prepared at a pH of 2.8 to 3.5, otherwise they would form particles at higher pH ranges. Highly purified insulin preparations, however, can be prepared at a range of pH values. Also, buffering the insulin preparation allows insulin to be prepared in a solution over a wider range of pH. Typically, an insulin that is prepared at neutral pH has a greater stability then those prepared at acidic pH. Thus, most insulins are formulated at neutral pH. An exception is insulin glargine, which is provided as a commercial formulation at pH 4.0. By virtue of the addition of two arginines to the C-terminus of the B-chain, the isoelectric point of the glargine insulin is shifted making it more soluble at an acidic pH. An additional amino acid change exists in the A chain (N21 G) to prevent deamidation and dimerization resulting from an acid-sensitive asparagine. The sequence of the A chain of glargine insulin is set forth in SEQ ID NO:150 and the B-chain is set forth in SEQ ID NO:151. Since exposure to physiologic pH occurs upon administration, microprecipitates are formed, which make glargine similar to a crystalline, long-acting insulin.

Table 2 below summarizes various types of insulin, their onset of action and their application.

TABLE 2

| Types of Insulins | | | | | |
|---|---|---|---|---|---|
| Type | Brand name | Onset | Peak | Duration | Application |
| Fast-acting: Insulin analogs | Lispro (e.g. Humalog®); Aspart (e.g., NovoLog®); Glulisine | 5-15 minutes | 45-90 minutes | 3-4 hours | Post-prandial glucose control |

TABLE 2-continued

Types of Insulins

| Type | Brand name | Onset | Peak | Duration | Application |
|---|---|---|---|---|---|
| Fast-acting: Regular insulin | Regular Insulin (e.g., Humulin® R; Novolin® R; Velosulin ® Human) | 30 minutes-1 hour | 2-5 hours | 5-8 hours | Post-prandial glucose control |
| Intermediate-Acting | Lente® (e.g., Humulin® L, Novolin® L); NPH (e.g., Humulin® N, Novolin® N); | 1-3 hours | 6-12 hours | 20-24 hours | Basal insulin supplementation |
| Long-lasting | Ultralente (e.g. Humulin® U); glargine; detemir (an analog) | 4-6 hours | 18-28 hours | 28 hours | Basal insulin supplementation |
| Mixtures | Humulin® 50/50; Humulin® 70/30; Novolin® 70/30; Humalog® Mix 75/25 | Varies | Varies | Varies | |

The most commonly used insulins are fast-acting insulins, which include regular insulin (i.e. native or wildtype insulin, including allelic and species variants thereof) and fast-acting insulin analogs. For purposes herein, reference to insulin is a fast-acting insulin, unless specifically noted otherwise.

Fast-Acting Insulin

Provided herein are super fast-acting insulin compositions that contain a fast-acting insulin and a soluble hyaluronan degrading enzyme. Generally, these super fast-acting insulin compositions are absorbed following subcutaneous administration and are detectable and have an onset of action in the blood within 30 minutes or less. Fact-acting insulins that can be used to obtain a super fast-acting insulin composition as described herein include regular insulin, which is the wild-type or native insulin. Fast-acting insulins also include insulin analogs. By virtue of their fast absorption rate compared to basal-acting insulins, fast-acting insulins are used predominantly for post-prandial control purposes. Exemplary fast-acting insulins are set forth in Table 3 below. Fast-acting insulins also include any known in the art, such as, but not limited to, any insulin preparations and devices disclosed in U.S. Pat. No. 7,279,457 and US Patent Publications 20070235365, 20080039368, 20080039365, 20070086952, 20070244467, and 20070191757. Any fast-acting insulin can be rendered super fast-acting by co-formulation and/or co-administration with a hyaluronan degrading enzyme. A super fast-acting insulin composition formulation also can further include a mixture of a fast-acting insulin with an intermediate or long-acting insulin, in addition to a hyaluronan degrading enzyme.

TABLE 3

FAST-ACTING INSULINS

| Name | Species | A-chain (SEQ ID NO) | B-chain (SEQ ID NO) | Commercial Name |
|---|---|---|---|---|
| Regular Insulin | Human | SEQ ID NO: 103 | SEQ ID NO: 104 | e.g. Humulin ®; Novolin ® R; Velosulin ® |
| Regular Insulin | Porcine | 88-108 of SEQ ID NO: 123 | 25-54 of SEQ ID NO: 123 | Iletin II ®; |
| Aspart Insulin | Human analog | SEQ ID NO: 103 | SEQ ID NO: 147 | Novolog ® |
| Lispro Insulin | Human analog | SEQ ID NO: 103 | SEQ ID NO: 148 | Humalog ® |
| Glulisine Insulin | Human analog | SEQ ID NO: 103 | SEQ ID NO: 149 | Apidra ® | a. Regular Insulin

Regular insulins include formulations that include the native or wildtype insulin polypeptide. These include human insulin, as well as insulins from bovine, porcine and other species. Such insulins can be prepared at an acidic pH (e.g., 2.5-3.5) or can be prepared at a neutral pH (e.g., 7.0-7.8). Regular insulins also include those that contain zinc. Typically, the zinc content in regular insulin preparations ranges from at or about 0.01-0.04 mg/100 Units. Regular human insulins are marketed as Humulin® R, Novolin® R and Velosulin®. Porcine insulin was marketed as Iletin II®. Generally, regular insulin has an onset of action of 30 minutes after subcutaneous administration. Maximal plasma levels are seen in 1-3 hours and the duration of intensity increases with dosage. The plasma half-life following subcutaneous administration is about 1.5 hours.

b. Fast-Acting Analogs

Fast-Acting insulin analogs are modified forms of insulin that typically contain one or more amino acid changes. The analogs are designed to reduce the self-association of the insulin molecule for the purpose of increasing the absorption rate and onset of action as compared to regular insulin. Generally, such analogs are formulated in the presence of zinc, and thus exist as stable zinc hexamers. Due to the modification, however, they have a quicker dissociation from the hexameric state after subcutaneous administration compared to regular insulin.

i. Insulin Lispro

Human insulin Lispro is an insulin polypeptide formulation containing amino acid changes at position 28 and 29 of the B-chain such that the Pro-Lys at this position in wild-type insulin B-chain set forth in SEQ ID NO:104 is inverted to Lys-Pro. The sequence of insulin lispro is set forth in SEQ ID NO:103 (A-chain) and SEQ ID NO: 148 (B-chain). It is marketed under the name Humalog®. The result of the inversion of these two amino acids is a polypeptide with a decreased propensity to self-associate, which allows for a more rapid onset of action. Specifically, the sequence inversion in the B-chain results in the elimination of two hydrophobic interactions and weakening of two beta-pleated sheet hydrogen bonds that stabilize the dimer (see e.g., DeFelippis et al. (2002) Insulin Chemistry and Pharmacokinetics. In Ellenberg and Rifkin's Diabetes Mellitus (pp. 481-500) McGraw-Hill Professional). The polypeptide self-associates and forms hexamers as a result of excipients provided in the formulation, such as antimicrobial agents (e.g. m-cresol) and zinc for stabilization. Nevertheless, due to the amino acid modification, insulin lispro is more rapidly acting then regular insulin.

ii. Insulin Aspart

Human insulin aspart is an insulin polypeptide formulation containing an amino acid substitution at position 28 of the B-chain of human insulin set forth in SEQ ID NO:104 from a proline to an aspartic acid. The sequence of insulin aspart is set forth in SEQ ID NO:103 (A-chain) and SEQ ID NO:147 (B-chain). It is marketed under the name Novolog®. The modification in insulin aspart confers a negatively-charged side-chain carboxyl group to create charge repulsion and destabilize the monomer-monomer interaction. Further, the removal of the proline eliminates a key hydrophobic interaction between monomers (see e.g., DeFelippis et al. (2002) *Insulin Chemistry and Pharmacokinetics*. In Ellenberg and Rifkin's Diabetes Mellitus (pp. 481-500) McGraw-Hill Professional). The analog exists largely as a monomer, and is less prone to aggregate compared to other fast-acting analogs such as lispro. Generally, insulin aspart and insulin lispro are similar in their respective pharmacokinetic and phamacodynamic properties.

iii. Insulin Glulisine

Human insulin glulisine is an insulin polypeptide formulation containing an amino acid substitution in the B-chain at position B3 from asparagine to lysine and at amino acid B29 from lysine to glutamic acid compared to the sequence of the B-chain of human insulin set forth in SEQ ID NO:104. The sequence of insulin glulisine is set forth in SEQ ID NO:103 (A-chain) and SEQ ID NO:149 (B-chain). It is marketed under the name Apidra®. The modifications render the polypeptide molecule less prone to self-association compared to human insulin. Unlike other insulin analogs, the polypeptide is commercially formulated in the absence of the hexamer-promoting zinc (Becker et al. (2008) *Clinical Pharmacokinetics*, 47:7-20). Hence, insulin glulisine has a more rapid rate of onset than insulin lispro and insulin aspart.

D. Hyaluronan Degrading Enzymes

Provided herein are super fast-acting insulin compositions and combinations resulting from combination of a fast-acting insulin and a hyaluronan (hyaluronic acid) degrading enzyme, and methods of using such compositions and combinations for the treatment of insulin-mediated diseases and conditions. Hyaluronan degrading enzymes include any enzyme that degrades hyaluronan. Exemplary hyaluronan degrading enzymes include, but are not limited to hyaluronidases and particular chondroitinases and lyases that have the ability to cleave hyaluronan. Where the methods and uses provided herein describe the use of a hyaluronidase with insulin, accordingly any hyaluronan degrading enzyme can be used. Exemplary of hyaluronan degrading enzymes in the compositions, combinations and methods provided herein are soluble hyaluronan degrading enzymes. By virtue of the ability of hyaluronan degrading enzymes, such as a hyaluronidase, to break down hyaluronic acid in the extracellular matrix, such enzymes facilitate administration of therapeutic agents. For example, the absorption and dispersion of therapeutics that are co-administered with a hyaluronan degrading enzyme such as by subcutaneous administration, are increased.

Hyaluronan, also called hyaluronic acid or hyaluronate, is a non-sulfated glycosaminoglycan that is widely distributed throughout connective, epithelial, and neural tissues. Hyaluronan is an essential component of the extracellular matrix and a major constituent of the interstitial barrier. By catalyzing the hydrolysis of hyaluronan, hyaluronan degrading enzymes lower the viscosity of hyaluronan, thereby increasing tissue permeability and increasing the absorption rate of fluids administered parenterally. As such, hyaluronan degrading enzymes, such as hyaluronidases, have been used, for example, as spreading or dispersing agents in conjunction with other agents, drugs and proteins to enhance their dispersion and delivery.

Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating $\beta$-1→4 and $\beta$-1→3 glycosidic bonds. Hyaluronan chains can reach about 25,000 disaccharide repeats or more in length and polymers of hyaluronan can range in size from about 5,000 to 20,000,000 Da in vivo. Accordingly, hyaluronan degrading enzymes for the uses and methods provided include any enzyme having the ability to catalyze the cleavage of a hyaluronan disaccharide chain or polymer. In some examples the hyaluronan degrading enzyme cleaves the $\beta$-1→4 glycosidic bond in the hyaluronan chain or polymer. In other examples, the hyaluronan degrading enzyme catalyze the cleavage of the $\beta$-1→3 glycosidic bond in the hyaluronan chain or polymer.

As described below, hyaluronan-degrading enzymes exist in membrane-bound or soluble form. For purposes herein, soluble hyaluronan-degrading enzymes are provided for use in the methods, uses, compositions or combinations herein. Thus, where hyaluronan-degrading enzymes include a glycosylphosphatidylinositol (GPI) anchor and/or are otherwise membrane-anchored or insoluble, hyaluronan-degrading enzymes are provided herein in soluble form. Thus, hyaluronan-degrading enzymes include truncated variants, e.g. truncated to remove all or a portion of a GPI anchor. Hyaluronan-degrading enzymes provide herein also include allelic or species variants or other variants, of a soluble hyaluronan-degrading enzyme. For example, hyaluronan degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan degrading enzyme not containing the variation (as measured by in vitro and/or in vivo assays well known in the art and described herein).

1. Hyaluronidases

Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Such enzymes can be used in the compositions, combinations and methods provided.

a. Mammalian-type Hyaluronidases

Mammalian-type hyaluronidases (EC 3.2.1.35) are endo-β-N-acetyl-hexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, hyaluronidases from cows (bovine) (SEQ ID NOS:10, 11 and 64 and BH55 (U.S. Pat. Nos. 5,747,027 and 5,827,721)), sheep (ovis aries) (SEQ ID NO: 26, 27, 63 and 65), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), orangutan (SEQ ID NO:28), cynomolgus monkey (SEQ ID NO:29), guinea pig (SEQ ID NO:30), and human hyaluronidases. Exemplary of hyaluronidases in the compositions, combinations and methods provided herein are soluble hyaluronidases Mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NO:27), bovine (SEQ ID NO:11) and human (SEQ ID NO:1). Human PH20 (also known as SPAM 1 or sperm surface protein PH20), is generally attached to the plasma membrane via a glycosylphosphatidyl inositol (GPI) anchor. It is naturally involved in sperm-egg adhesion and aids penetration by sperm of the layer of cumulus cells by digesting hyaluronic acid.

Besides human PH20 (also termed SPAM1), five hyaluronidase-like genes have been identified in the human genome, HYAL1, HYAL2, HYAL3, HYAL4 and HYALP1. HYALP1 is a pseudogene, and HYAL3 (SEQ ID NO:38) has not been shown to possess enzyme activity toward any known substrates. HYAL4 (precursor polypeptide set forth in SEQ ID NO:39) is a chondroitinase and exhibits little activity towards hyaluronan. HYAL1 (precursor polypeptide set forth in SEQ ID NO:36) is the prototypical acid-active enzyme and PH20 (precursor polypeptide set forth in SEQ ID NO:1) is the prototypical neutral-active enzyme. Acid-active hyaluronidases, such as HYAL1 and HYAL2 (precursor polypeptide set forth in SEQ ID NO:37) generally lack catalytic activity at neutral pH (i.e. pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosylphosphatidyl inositol (GPI) anchor such as human HYAL2 and human PH20 (Danilkovitch-Miagkova, et al. (2003) *Proc Natl Acad Sci USA* 100(8):4580-5), and those which are generally soluble such as human HYAL1 (Frost et al. (1997) *Biochem Biophys Res Commun.* 236(1):10-5).

$PH_{120}$

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. They have both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 also appears to be a receptor for HA-induced cell signaling, and a receptor for the zona pellucida surrounding the oocyte.

Exemplary PH20 proteins include, but are not limited to, human (precursor polypeptide set forth in SEQ ID NO:1, mature polypeptide set forth in SEQ ID NO: 2), chimpanzee (SEQ ID NO:185), Rhesus monkey (SEQ ID NO:186) bovine (SEQ ID NOS: 11 and 64), rabbit (SEQ ID NO: 25), ovine PH20 (SEQ ID NOS: 27, 63 and 65), Cynomolgus monkey (SEQ ID NO: 29), guinea pig (SEQ ID NO: 30), rat (SEQ ID NO: 31) and mouse (SEQ ID NO: 32) PH20 polypeptides.

Bovine PH20 is a 553 amino acid precursor polypeptide (SEQ ID NO: 11). Alignment of bovine PH20 with the human PH20 shows only weak homology, with multiple gaps existing from amino acid 470 through to the respective carboxy termini due to the absence of a GPI anchor in the bovine polypeptide (see e.g., Frost G1 (2007) *Expert Opin. Drug. Deliv.* 4: 427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-36). This unique feature of bovine hyaluronidase has permitted the use of the soluble bovine testes hyaluronidase enzyme as an extract for clinical use (Wydase®, Hyalase®).

The human PH20 mRNA transcript is normally translated to generate a 509 amino acid precursor polypeptide (SEQ ID NO:1; and replicated below) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 is, therefore, a 474 amino acid polypeptide set forth in SEQ ID NO:2. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:1. Thus, a 474 amino acid GPI-anchored mature polypeptide with an amino acid sequence set forth in SEQ ID NO:2 is produced.

Amino acid sequence of the human PH20 precursor polypeptide (SEQ ID NO: 1; 509 amino acids):

MGVLKFKHIFFRSFVKSSGVSQIVFTFLLIPCCLTLNFRAPPVIPNVP

FLWAWNAPSEFCLGKFDEPLDMSLFSFIGSPRINATGQGVTIFYVDRL

GYYPYIDSITGVTVNGGIPQKISLQDHLDKAKKDITFYMPVDNLGMAV

IDWEEWRPTWARNWKPKDVYKNRSIELVQQQNVQLSLTEATEKAKQEF

EKAGKDFLVETIKLGKLLRPNHLWGYYLFPDCYNHHYKKPGYNGSCFN

VEIKRNDDLSWLWNESTALYPSIYLNTQQSPVAATLYVRNRVREAIRV

SKIPDAKSPLPVFAYTRIVFTDQVLKFLSQDELVYTFGETVALGASGI

VIWGTLSIMRSMKSCLLLDNYMETILNPYIINVTLAAKMCSQVLCQEQ

GVCIRKNWNSSDYLHLNPDNFAIQLEKGGKFTVRGKPTLEDLEQFSEK

FYCSCYSTLSCKEKADVKDTDAVDVCIADGVGIDAFLKPPMETEEPQI

FYNASPSTLSATMFIVSILFLIISSVASL

Human PH20 exhibits hyaluronidase activity at both neutral and acid pH. In one aspect, human PH20 is the prototypical neutral-active hyaluronidase that is generally locked to the plasma membrane via a GPI anchor. In another aspect, PH20 is expressed on the inner acrosomal membrane where it has hyaluronidase activity at both neutral and acid pH. It appears that PH20 contains two catalytic sites at distinct regions of the polypeptide: the Peptide 1 and Peptide 3 regions (Cherr et al., (2001) Matrix Biology 20:515-525). Evidence suggests that the Peptide 1 region of PH20, which corresponds to amino acid positions 107-137 of the mature polypeptide set forth in SEQ ID NO:2 and positions 142-172 of the precursor polypeptide set forth in SEQ ID NO:1, is required for enzyme activity at neutral pH. Amino acids at positions 111 and 113 (corresponding to the mature PH20 polypeptide set forth in SEQ ID NO:2) within this region appear to be important for activity, as mutagenesis by amino acid replacement results in PH20 polypeptides with 3% hyaluronidase activity or undetectable hyaluronidase activity, respectively, compared to the wild-type PH20 (Arming et al., (1997) Eur. J. Biochem. 247: 810-814).

The Peptide 3 region, which corresponds to amino acid positions 242-262 of the mature polypeptide set forth in SEQ ID NO:2, and positions 277-297 of the precursor polypeptide set forth in SEQ ID NO: 1, appears to be important for enzyme activity at acidic pH. Within this region, amino acids at positions 249 and 252 of the mature PH20 polypeptide appear to be essential for activity, and mutagenesis of either one results in a polypeptide essentially devoid of activity (Arming et al., (1997) Eur. J. Biochem. 247:810-814).

In addition to the catalytic sites, PH20 also contains a hyaluronan-binding site. Experimental evidence suggest that this site is located in the Peptide 2 region, which corresponds to amino acid positions 205-235 of the precursor polypeptide set forth in SEQ ID NO: 1 and positions 170-200 of the mature polypeptide set forth in SEQ ID NO:2. This region is highly conserved among hyaluronidases and is similar to the heparin binding motif. Mutation of the arginine residue at position 176 (corresponding to the mature PH20 polypeptide set forth in SEQ ID NO:2) to a glycine results in a polypeptide with only about 1% of the hyaluronidase activity of the wild type polypeptide (Arming et al., (1997) Eur. J. Biochem. 247:810-814).

There are seven potential N-linked glycosylation sites in human PH20 at N82, N166, N235, N254, N368, N393, N490 of the polypeptide exemplified in SEQ ID NO: 1. Because amino acids 36 to 464 of SEQ ID NO:1 appears to contain the minimally active human PH20 hyaluronidase domain, the N-linked glycosylation site N-490 is not required for proper hyaluronidase activity. There are six disulfide bonds in human PH20. Two disulphide bonds between the cysteine residues C60 and C351 and between C224 and C238 of the polypeptide exemplified in SEQ ID NO: 1 (corresponding to residues C25 and C316, and C189 and C203 of the mature polypeptide set forth in SEQ ID NO:2, respectively). A further four disulphide bonds are formed between the cysteine residues C376 and C387; between C381 and C435; between C437 and C443; and between C458 and C464 of the polypeptide exemplified in SEQ ID NO: 1 (corresponding to residues C341 and C352; between C346 and C400; between C402 and C408; and between C423 and C429 of the mature polypeptide set forth in SEQ ID NO:2, respectively).

b. Bacterial Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for use in the compositions, combinations and methods provided include, but are not limited to, hyaluronan degrading enzymes in microorganisms, including strains of *Arthrobacter, Bdellovibrio, Clostridium, Micrococcus, Streptococcus, Peptococcus, Propionibacterium, Bacteroides*, and *Streptomyces*. Particular examples of such enzymes include, but are not limited to *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73), *Staphylococcus aureus* (strain COL) (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81), *Streptococcus pneumoniae* ((SEQ ID NO:82); strain ATCC BAA-255/R6 (SEQ ID NO:83); serotype 2, strain D39/NCTC 7466 (SEQ ID NO:84), *Streptococcus pyogenes* (serotype M1) (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92); *Streptococcus suis* (SEQ ID NOS:93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607).

c. Hyaluronidases from Leeches, Other Parasites and Crustaceans

Hyaluronidases from leeches, other parasites, and crustaceans (EC 3.2.1.36) are endo-β-glucuronidases that generate tetra- and hexasaccharide end-products. These enzymes catalyze hydrolysis of 1→3-linkages between β-D-glucuronate and N-acetyl-D-glucosamine residues in hyaluronate. Exemplary hyaluronidases from leeches include, but are not limited to, hyaluronidase from Hirudinidae (e.g., *Hirudo medicinalis*), Erpobdellidae (e.g., *Nephelopsis obscura* and *Erpobdella punctata*), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol. Biol.* 124(3):319-26). An exemplary hyaluronidase from bacteria that has the same mechanism of action as the leech hyaluronidase is that from the cyanobacteria, *Synechococcus* sp. (strain RCC307, SEQ ID NO:97).

2. Other Hyaluronan Degrading Enzymes

In addition to the hyaluronidase family, other hyaluronan degrading enzymes can be used in conjunction with the fast-acting insulin in the compositions, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem.* 243(7):1523-1535; Yang et al. (1985) *J. Biol. Chem.* 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol. Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272: 9123-9130). A exemplary chondroitin-sulfate-ABC endolyases and chondroitin-sulfate-ABC exolyases include, but are not limited to, those from *Proteus vulgaris* and *Flavobacterium* heparinum (the *Proteus vulgaris* chondroitin-sulfate-ABC endolyase is set forth in SEQ ID NO: 98 (Sato et al. (1994) *Appl. Microbiol. Biotechnol.* 41(1):39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS:99 and 100, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-0S). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133)

3. Soluble Hyaluronan Degrading Enzymes

Provided in the compositions, combinations and methods herein are soluble hyaluronan degrading enzymes, including soluble hyaluronidases. Soluble hyaluronan degrading enzymes include any hyaluronan degrading enzymes that exist in soluble form, including, but not limited to, soluble hyaluronidases, including non-human soluble hyaluronidases, including non-human animal soluble hyaluronidases, bacterial soluble hyaluronidases and human hyaluronidases, Hyal1, bovine PH20 and ovine PH20, allelic variants thereof and other variants thereof. For example, included among soluble hyaluronan degrading enzymes are any hyaluronan degrading enzymes that have been modified to be soluble, including any described in U.S. Provisional Application Ser. No. 61/201,384 (incorporated by reference in its entirety). For example, hyaluronan degrading enzymes that contain a GPI anchor can be made soluble by truncation of and removal of all or a portion of the GPI anchor. In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme for use in the compositions, combinations and methods herein is a soluble neutral active hyaluronidase.

Exemplary of a soluble hyaluronidase is PH20 from any species, such as any set forth in any of SEQ ID NOS: 1, 2, 11, 25, 27, 30, 31, 63-65 and 185-186, or truncated forms thereof lacking all or a portion of the C-terminal GPI anchor, so long as the hyaluronidase is soluble and retains hyaluronidase activity. Also included among soluble hyaluronidases are allelic variants or other variants of any of SEQ ID NOS:1, 2, 11, 25, 27, 30 31, 63-65 and 185-186, or truncated forms thereof. Allelic variants and other variants are known to one of skill in the art, and include polypeptides having 60%, 70%, 80%, 90%, 91%, 92%, 93%, 94%, 95%. 96%. 97%. 98% or more sequence identity to any of SEQ ID NOS: 1, 2, 11, 25, 27, 30, 31, 63-65 and 185-186, or truncated forms thereof. Amino acid variants include conservative and non-conservative mutations. It is understood that residues that are important or otherwise required for the activity of a hyaluronidase, such as any described above or known to skill in the art, are generally invariant. These include, for example, active site residues. Thus, for example, amino acid residues 111, 113 and 176 (corresponding to residues in the mature PH20 polypeptide set forth in SEQ ID NO:2) of a human PH20 polypeptide, or soluble form thereof, are generally invariant and are not altered. Other residues that confer glycosylation and formation of disulfide bonds required for proper folding also can be invariant.

In some instances, the soluble hyaluronan degrading enzyme is normally GPI-anchored (such as, for example, human PH20) and is rendered soluble by truncation at the C-terminus. Such truncation can remove of all of the GPI anchor attachment signal sequence, or can remove only some of the GPI anchor attachment signal sequence. The resulting polypeptide, however, is soluble. In instances where the soluble hyaluronan degrading enzyme retains a portion of the GPI anchor attachment signal sequence, 1, 2, 3, 4, 5, 6, 7 or more amino acid residues in the GPI-anchor attachment signal sequence can be retained, provided the polypeptide is soluble. Polypeptides containing one or more amino acids of the GPI anchor are termed extended soluble hyaluronan degrading enzymes. One of skill in the art can determine whether a polypeptide is GPI-anchored using methods well known in the art. Such methods include, but are not limited to, using known algorithms to predict the presence and location of the GPI-anchor attachment signal sequence and c)-site, and performing solubility analyses before and after digestion with phosphatidylinositol-specific phospholipase C (PI-PLC) or D (PI-PLD).

Extended soluble hyaluronan degrading enzymes can be produced by making C-terminal truncations to any naturally GPI-anchored hyaluronan degrading enzyme such that the resulting polypeptide is soluble and contains one or more amino acid residues from the GPI-anchor attachment signal sequence. Exemplary extended soluble hyaluronan degrading enzymes that are C-terminally truncated but retain a portion of the GPI anchor attachment signal sequence include, but are not limited to, extended soluble PH20 (esPH20) polypeptides of primate origin, such as, for example, human and chimpanzee esPH20 polypeptides. For example, the esPH20 polypeptides can be made by C-terminal truncation of any of the mature or precursor polypeptides set forth in SEQ ID NOS:1, 2 or 185, or allelic or other variation thereof, including active fragment thereof, wherein the resulting polypeptide is soluble and retains one or more amino acid residues from the GPI-anchor attachment signal sequence. Allelic variants and other variants are known to one of skill in the art, and include polypeptides having 60%, 70%, 80%, 90%, 91%, 92%, 93%, 94%, 95% or more sequence identity to any of SEQ ID NOS: 1 or 2. The esPH20 polypeptides provided herein can be C-terminally truncated by 1, 2, 3, 4, 5, 6, 7, 8, 9, 10 or more amino acids compared to the wild type polypeptide, such as a polypeptide with a sequence set forth in SEQ ID NOS: 1, 2 or 185, provided the resulting esPH20 polypeptide is soluble and retains 1 or more amino acid residues from the GPI-anchor attachment signal sequence.

Typically, for use in the compositions, combinations and methods herein, a soluble human hyaluronan degrading enzyme, such as a soluble human PH20, is used. Although hyaluronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

a. Soluble Human PH20

Exemplary of a soluble hyaluronidase is soluble human PH20, Soluble forms of recombinant human PH20 have been produced and can be used in the compositions, combinations and methods described herein. The production of such soluble forms of PH20 is described in U.S. Published Patent Application Nos. US20040268425; US 20050260186 and US20060104968 (incorporated by reference in their entirety), and in the Examples, below. For example, soluble PH20 polypeptides, include C-terminally truncated variant polypeptides that include a sequence of amino acids in SEQ ID NO:1, or have at least 91%, 92%, 93%, 94%, 95%, 95%, 97%, 98% sequence identity to a sequence of amino acids included in SEQ ID NO:1, retain hyaluronidase activity and are soluble. Included among these polypeptides are soluble PH20 polypeptides that completely lack all or a portion of the GPI-anchor attachment signal sequence. Also included are extended soluble PH20 (esPH20) polypeptides that contain at least one amino acid of the GPI anchor. Thus, instead of having a GPI-anchor covalently attached to the C-terminus of the protein in the ER and being anchored to the extracellular leaflet of the plasma membrane, these polypeptides are secreted and are soluble. C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 5, 60 or more amino acids compared to the full length wild type polypeptide, such as a full length wild type polypeptide with a sequence set forth in SEQ ID NOS:1 or 2, or allelic or species variants or other variants thereof.

Exemplary C-terminally truncated human PH20 polypeptides provided herein include any having C-terminal truncations to generate polypeptides containing amino acid 1 to amino acid 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, of the sequence of amino acids set forth in SEQ ID NO: 1, or corresponding positions in an allelic or species variant thereof. When expressed in mammalian cells, the 35 amino acid N-terminal signal sequence is cleaved during processing, and the mature form of the protein is secreted. Thus, exemplary mature C-terminally truncated soluble PH20 polypeptides can contain amino acids 36 to 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497 of the sequence of amino acids set forth in SEQ ID NO: 1 or corresponding positions in an allelic or species variant thereof. Table 4 provides non-limiting examples of exemplary C-terminally truncated PH20 polypeptides, including C-terminally truncated soluble PH20 polypeptides. In Table 4 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 4 for comparison.

TABLE 4

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| wildtype | 509 | 1 | 474 | 2 |
| SPAM1-FIVS | 497 | 191 | 462 | 235 |
| SPAM1-MFIV | 496 | 225 | 461 | 269 |
| SPAM1-TMFI | 495 | 192 | 460 | 236 |
| SPAM1-ATMF | 494 | 226 | 459 | 270 |
| SPAM1-SATM | 493 | 193 | 458 | 237 |
| SPAM1-LSAT | 492 | 227 | 457 | 271 |
| SPAM1-TLSA | 491 | 194 | 456 | 238 |
| SPAM1-PSTL | 489 | 195 | 454 | 239 |
| SPAM1-SPST | 488 | 228 | 453 | 272 |
| SPAM1-STLS | 490 | 196 | 455 | 240 |
| SPAM1-ASPS | 487 | 197 | 452 | 241 |
| SPAM1-NASP | 486 | 229 | 451 | 273 |
| SPAM1-YNAS | 485 | 198 | 450 | 242 |
| SPAM1-FYNA | 484 | 199 | 449 | 243 |
| SPAM1-IFYN | 483 | 46 | 448 | 48 |
| SPAM1-QIFY | 482 | 3 | 447 | 4 |
| SPAM1-PQIF | 481 | 45 | 446 | 5 |
| SPAM1-EPQI | 480 | 44 | 445 | 6 |
| SPAM1-EEPQ | 479 | 43 | 444 | 7 |
| SPAM1-TEEP | 478 | 42 | 443 | 8 |
| SPAM1-ETEE | 477 | 41 | 442 | 9 |
| SPAM1-METE | 476 | 200 | 441 | 244 |
| SPAM1-PMET | 475 | 201 | 440 | 245 |
| SPAM1-PPME | 474 | 202 | 439 | 246 |
| SPAM1-KPPM | 473 | 203 | 438 | 247 |
| SPAM1-LKPP | 472 | 204 | 437 | 248 |
| SPAM1-FLKP | 471 | 205 | 436 | 249 |
| SPAM1-AFLK | 470 | 206 | 435 | 250 |
| SPAM1-DAFL | 469 | 207 | 434 | 251 |
| SPAM1-IDAF | 468 | 208 | 433 | 252 |
| SPAM1-CIDA | 467 | 40 | 432 | 47 |
| SPAM1-VCID | 466 | 209 | 431 | 253 |
| SPAM1-GVCI | 465 | 210 | 430 | 254 |

Soluble forms include, but are not limited to, any having C-terminal truncations to generate polypeptides containing amino acids 1 to amino acid 467, 477, 478, 479, 480, 481, 482 and 483 of the sequence of amino acids set forth in SEQ ID NO:1. When expressed in mammalian cells, the 35 amino acid N-terminal signal sequence is cleaved during processing, and the mature form of the protein is secreted. Thus, the mature soluble polypeptides contain amino acids 36 to 467, 477, 478, 479, 480, 481, 482 and 483 of SEQ ID NO:1. Deletion mutants ending at amino acid position 477 to 483 (corresponding to the precursor polypeptide set forth in SEQ ID NO: 1) exhibit higher secreted hyaluronidase activity than the full length GPI-anchored form. Hence, exemplary of soluble hyaluronidases soluble human PH20 polypeptides that are 442, 443, 444, 445, 446 or 447 amino acids in length, such as set forth in any of SEQ ID NOS: 4-9, or allelic or species variants or other variants thereof.

Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g. DG44 CHO cells).

b. rHuPH20

Recombinant soluble forms of human PH20 have been generated and can be used in the compositions, combinations and methods provided herein. The generation of such soluble forms of recombinant human PH20 are described in U.S. Published Patent Application Nos. US20040268425; US 20050260186 and US20060104968, and in Examples 2-6, below. Exemplary of such polypeptides are those generated from a nucleic acid molecule encoding amino acids 1-482 (set forth in SEQ ID NO:3). Such an exemplary nucleic acid molecule is set forth in SEQ ID NO:49. Post translational processing removes the 35 amino acid signal sequence, leaving a 447 amino acid soluble recombinant human PH20 (SEQ ID NO:4). As produced in the culture medium there is heterogeneity at the C-terminus such that the product, designated rHuPH20, includes a mixture of species that can include any one or more of SEQ ID NOS. 4-9 in various abundance. Typically, rHuPH20 is produced in cells that facilitate correct N-glycosylation to retain activity, such as CHO cells (e.g. DG44 CHO cells).

4. Glycosylation of Hyaluronan Degrading Enzymes

Glycosylation, including N- and O-linked glycosylation, of some hyaluronan degrading enzymes, including hyaluronidases, can be important for their catalytic activity and stability. While altering the type of glycan modifying a glycoprotein can have dramatic affects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man) 3-GlcNAc-GlcNAc-cores attached via the amide nitrogen of Asn residues that fall within-Asn-Xaa-Thr/Ser-sequences (where Xaa is not Pro). Glycosylation at an-Asn-Xaa-Cys-site has been reported for coagulation protein C. In some instances, a hyaluronan degrading enzyme, such as a hyaluronidase, can contain both N-glycosidic and O-glycosidic linkages. For example, PH20 has O-linked oligosaccharides as well as N-linked oligosaccharides. There are seven potential N-linked glycosylation sites at N82, N166, N235, N254, N368, N393, N490 of human PH20 exemplified in SEQ ID NO: 1. As noted above, N-linked glycosylation at N490 is not required for hyaluronidase activity.

In some examples, the hyaluronan degrading enzymes for use in the compositions, combinations and/or methods provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO: 1 are glycosylated. In some examples the hyaluronan degrading enzymes are glycosylated at one or more native glycosylation sites. In other examples, the hyaluronan degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

In other examples, the hyaluronan degrading enzymes for use in the compositions, combinations and/or methods provided herein are partially deglycosylated (or N-partially glycosylated polypeptides). For example, partially deglycosylated soluble PH20 polypeptides that retain all or a portion of the hyaluronidase activity of a fully glycosylated hyaluronidase can be used in the compositions, combinations and/or methods provided herein. Exemplary partially deglycosylated hyaluronidases include soluble forms of a partially deglycosylated PH20 polypeptides from any species, such as any set forth in any of SEQ ID NOS: 1, 2, 11, 25, 27, 29, 30, 31, 32, 63, 65, 185 and 186, or allelic variants, truncated variants, or other variants thereof Such variants are known to one of skill in the art, and include polypeptides having 60%, 70%, 80%, 90%, 91%, 92%, 93%, 94%, 95% or more sequence identity to any of SEQ ID NOS: 1, 2, 11, 25, 27, 29, 30, 31, 32, 63, 65, 185 and 186, or truncated forms thereof. The partially deglycosylated hyaluronidases provided herein also include hybrid, fusion and chimeric partially deglycosylated hyaluronidases, and partially deglycosylated hyaluronidase conjugates.

Glycosidases, or glycoside hydrolases, are enzymes that catalyze the hydrolysis of the glycosidic linkage to generate two smaller sugars. The major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans. Treatment of a hyaluronan degrading enzyme, such as a soluble hyaluronidase, such as a soluble PH20, with one or all of these glycosidases can result in only partial deglycosylation and, therefore, retention of hyaluronidase activity.

Partially deglycosylated hyaluronan degrading enzymes, such as partially deglycosylated soluble hyaluronidases, can be produced by digestion with one or more glycosidases, generally a glycosidase that does not remove all N-glycans but only partially deglycosylates the protein. For example, treatment of PH20 (e.g. a recombinant PH20 designated rHuPH20) with one or all of the above glycosidases (e.g. EndoF1, EndoF2 and/or EndoF3) results in partial deglycosylation. These partially deglycosylated PH20 polypeptides can exhibit hyaluronidase enzymatic activity that is comparable to the fully glycosylated polypeptides. In contrast, treatment of PH20 with PNGaseF, a glycosidase that cleaves all N-glycans, results in complete removal of all N-glycans and thereby renders PH20 enzymatically inactive. Thus, although all N-linked glycosylation sites (such as, for example, those at amino acids N82, N166, N235, N254, N368, and N393 of human PH20, exemplified in SEQ ID NO: 1) can be glycosylated, treatment with one or more glycosidases can render the extent of glycosylation reduced compared to a hyaluronidase that is not digested with one or more glycosidases.

The partially deglycosylated hyaluronan degrading enzymes, including partially deglycosylated soluble PH20 polypeptides, can have 10%, 20%, 30%, 40%, 50%, 60%, 70% or 80% of the level of glycosylation of a fully glycosylated polypeptide. Typically, the partially deglycosylated hyaluronan degrading enzymes, including partially deglycosylated soluble PH20 polypeptides, exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated polypeptide.

5. Modifications of Hyaluronan Degrading Enzymes to Improve their Pharmacokinetic Properties Hyaluronan degrading enzymes can be modified to improve their pharmacokinetic properties, such as increasing their half-life in vivo and/or activities. The modification of hyaluronan degrading enzymes for use in the compositions, combinations and/or methods provided can include attaching, directly or indirectly via a linker, such as covalently or by other stable linkage, a polymer, such as dextran, a polyethylene glycol (pegylation (PEG)) or sialyl moiety, or other such polymers, such as natural or sugar polymers.

Pegylation of therapeutics is known to increase resistance to proteolysis, increase plasma half-life, and decrease antigenicity and immunogenicity. Covalent or other stable attachment (conjugation) of polymeric molecules, such as polyethylene glycol moiety (PEG), to the hyaluronan degrading enzyme thus can impart beneficial properties to the resulting enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Exemplary polymers that can be conjugated to the hyaluronan degrading enzyme, include natural and synthetic homopolymers, such as polyols (i.e. poly-OH), polyamines (i.e. poly-NH$_2$) and polycarboxyl acids (i.e. poly-COOH), and further heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polypropylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which, in comparison to polysaccharides such as dextran, pullulan and the like, have few reactive groups capable of cross-linking. Typically, the polymers are non-toxic polymeric molecules such as (m)polyethylene glycol (mPEG) which can be covalently conjugated to the hyaluronan degrading enzyme (e.g., to attachment groups on the protein surface) using a relatively simple chemistry.

Suitable polymeric molecules for attachment to the hyaluronan degrading enzyme include, but are not limited to, polyethylene glycol (PEG) and PEG derivatives such as methoxypolyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., Advanced Drug Delivery Review 2002, 54: 459-476; Harris and Zalipsky, S (eds.) "Poly(ethylene glycol), Chemistry and Biological Applications" ACS Symposium Series 680, 1997; Mehvar et al., J. Pharm. Pharmaceut. Sci., 3(1):125-136, 2000; Harris, Nature Reviews 2:215 et seq. (2003); and Tsubery, J. Biol. Chem. 279(37):38118-24, 2004). The polymeric molecule can be of a molecular weight typically ranging from about 3 kDa to about 60 kDa. In some embodiments the polymeric molecule that is conjugated to a protein, such as rHuPH20, has a molecular weight of 5, 10, 15, 20, 25, 30, 35, 40, 45, 50, 55, 60 or more than 60 kDa.

Various methods of modifying polypeptides by covalently attaching (conjugating) a PEG or PEG derivative (i.e. "PEGylation") are known in the art (see e.g., U.S. 2006/0104968; U.S. Pat. Nos. 5,672,662; 6,737,505; and U.S. 2004/0235734). Techniques for PEGylation include, but are not limited to, specialized linkers and coupling chemistries (see e.g., Harris, Adv. Drug Deliv. Rev. 54:459-476, 2002), attachment of multiple PEG moieties to a single conjugation site (such as via use of branched PEGs; see e.g., Veronese et al., Bioorg. Med. Chem. Lett. 12:177-180, 2002), site-specific PEGylation and/or mono-PEGylation (see e.g., Chapman et al., Nature Biotech. 17:780-783, 1999), and site-directed enzymatic PEGylation (see e.g., Sato, Adv. Drug Deliv. Rev., 54:487-504, 2002) (see, also, for example, Lu and Felix (1994) Int. J. Peptide Protein Res. 43:127-138; Lu and Felix (1993) Peptide Res. 6:142-6, 1993; Felix et al. (1995) Int. J. Peptide Res. 46:253-64; Benhar et al. (1994) J. Biol. Chem. 269:13398-404; Brumeanu et al. (1995) J Immunol. 154: 3088-95; see also, Caliceti et al. (2003) Adv. Drug Deliv. Rev. 55(10):1261-77 and Molineux (2003) Pharmacotherapy 23 (8 Pt 2):3S-8S). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Numerous reagents for PEGylation have been described in the art. Such reagents include, but are not limited to, N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG2 butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., Bioconjugate Chem. 6:62-69, 1995; Veronese et al., J. Bioactive Compatible Polymers 12:197-207, 1997; U.S. Pat. Nos. 5,672,662; 5,932,462; 6,495,659; 6,737,505; 4,002,531; 4,179,337; 5,122,614; 5,183,550; 5,324,844; 5,446,090; 5,612,460; 5,643,575; 5,766,581; 5,795,569; 5,808,096; 5,900,461; 5,919,455; 5,985,263; 5,990,237; 6,113,906; 6,214,966; 6,258,351; 6,340,742; 6,413,507; 6,420,339; 6,437,025; 6,448,369; 6,461,802; 6,828,401; 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; U.S. 2005/000360; U.S. 2005/0114037; U.S. 2005/0171328; U.S. 2005/0209416; EP 01064951; EP 0822199; WO 00176640; WO 0002017; WO 0249673; WO 9428024; and WO 0187925).

In one example, the hyaluronan degrading enzyme for use in the methods, compositions, and combinations provided is a soluble hyaluronidase that is PEGylated. In a particular example, the soluble hyaluronidase is a PEGylated PH20 hyaluronidase. In another particular example, the soluble hyaluronidase is PEGylated rHuPH20, such as that described in Example 10.

E. Methods of Producing Nucleic Acids Encoding an Insulin or Hyaluronan Degrading Enzyme and Polypeptides Thereof Polypeptides of an insulin and hyaluronan degrading enzyme set forth herein, can be obtained by methods well known in the art for protein purification and recombinant protein expression. Polypeptides also can be synthesized chemically. For example, the A-chain and B-chain of insulin can be chemically synthesized and then cross-linked by disulfide bonds through, for example, a reduction-reoxidation reaction. When the polypeptides are produced by recombinant means, any method known to those of skill in the art for identification of nucleic acids that encode desired genes can be used. Any method available in the art can be used to obtain a full length (i.e., encompassing the entire coding region) cDNA or genomic DNA clone encoding a hyaluronidase, such as from a cell or tissue source. Modified or variant insulins or hyaluronan degrading enzymes can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:54) or Flag Tag (DYKDDDDK; SEQ ID NO:55).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. The insertion into a cloning vector can, for example, be accomplished by ligating the DNA fragment into a cloning vector which has complementary cohesive termini. Insertion can be effected using TOPO cloning vectors (INVITROGEN, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

Insulin can be produced using a variety of techniques (see e.g. Ladisch et al (1992) Biotechnol. Prog. 8:469-478). In some examples, nucleic acid encoding a preproinsulin or proinsulin polypeptide is inserted into an expression vector. Upon expression, the preproinsulin or proinsulin polypeptide is converted to insulin by enzymatic or chemical methods that cleave the signal sequence and/or the C peptide, resulting in the A- and B-chains that are cross-linked by disulfide bonds through, for example, a reduction-reoxidation reaction (see e.g. Cousens et al., (1987) Gene 61:265-275, Chance et al., (1993) *Diabetes Care* 4:147-154). In another example, the nucleic acid encoding the A-chain and B-chain of an insulin are inserted into one or two expression vectors for co-expression as a single polypeptide from one expression vector or expression as two polypeptides from one or two expression vectors. Thus, the A- and B-chain polypeptides can be expressed separately and then combined to generate an insulin, or can be co-expressed, in the absence of a C chain. In instances where the A- and B-chains are co-expressed as a single polypeptide, the nucleic acid encoding the subunits also can encode a linker or spacer between the B-chain and A-chain, such as a linker or spacer described below. The nucleic acid inserted into the expression vector can contain, for example, nucleic acid encoding the insulin B-chain, a linker, such as for example, an alanine-alanine-lysine linker, and the A-chain, resulting in expression of, for example, "insulin B chain-Ala-Ala-Lys-insulin A chain."

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the soluble hyaluronidase polypeptide coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bemoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthetase promoter (Herrara-Estrella et al., *Nature* 303:209-213 (1984)) or the cauliflower mosaic virus 35S RNA promoter (Garder et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell. Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinckert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and TI transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from NOVAGEN, Madison, Wis.; see, also literature published by Novagen describing the system). Such plasmids include pET 11a, which contains the T71ac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (NOVAGEN, Madison, Wis.), which contain a His-Tag™ leader sequence for use in purification with a H is column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

2. Linker Moieties

In some examples, insulin is prepared by generating the A-chain and B-chain polypeptides with a linker, such that, for example, the C-terminus of the B-chain is joined to the N-terminus of the A-chain by a short linker. The A-chain and B-chains can be expressed from a single polypeptide containing a linker, or can be expressed separately and then joined by a linker. The linker moiety is selected depending upon the properties desired. The linker moiety should be long enough and flexible enough to allow the A-chain and B-chain to mimic the natural conformation of the insulin. Linkers can be any moiety suitable to the insulin A-chain and B-chain. Such moieties include, but are not limited to, peptidic linkages; amino acid and peptide linkages, typically containing between one and about 60 amino acids; chemical linkers, such as heterobifunctional cleavable cross-linkers, photo-cleavable linkers and acid cleavable linkers.

The linker moieties can be peptides. The peptide typically has from about 2 to about 60 amino acid residues, for example from about 5 to about 40, or from about 10 to about 30 amino acid residues. Peptidic linkers can conveniently be encoded by nucleic acid and incorporated in fusion proteins upon expression in a host cell, such as *E. coli*. In one example, an alanine-alanine-lysine (AAK) (SEQ ID NO:178) linker is encoded in a nucleic acid between nucleic acid encoding the insulin B-chain and nucleic acid encoding the A-chain, such that upon expression, an "insulin B-chain-AAK-insulin A chain" polypeptide is produced. Peptide linkers can be a flexible spacer amino acid sequence, such as those known in single-chain antibody research. Examples of such known linker moieties include, but are not limited to, RPPPPC (SEQ ID NO:166) or SSPPPPC (SEQ ID NO:167), GGGGS (SEQ ID NO:168), (GGGGS)$_n$ (SEQ. ID NO:169), GKSSGSG-SESKS (SEQ ID NO:170), GSTSGSGKSSEGKG (SEQ. ID NO:171), GSTSGSGKSSEGSGSTKG (SEQ ID NO:172), GSTSGSGKSSEGKG (SEQ ID NO:173), GSTSGSGK-PGSGEGSTKG (SEQ ID NO:174), EGKSSGSGSESKEF (SEQ ID NO:175), SRSSG (SEQ. ID NO:176) and SGSSC (SEQ ID NO:177).

Alternatively, the peptide linker moiety can be VM (SEQ ID NO: 179) or AM (SEQ ID NO: 180), or have the structure described by the formula: AM(G$_{2\ to\ 4}$S)$_x$AM wherein X is an integer from 1 to 11 (SEQ ID NO: 181). Additional linking moieties are described, for example, in Huston et al. (1988) *Proc. Natl. Acad. Sci. U.S.A.* 85:5879-5883; Whitlow, M., et al. (1993) Protein Engineering 6:989-995; Newton et al. (1996) *Biochemistry* 35:545-553; A. J. Cumber et al. (1992) *Bioconj. Chem.* 3:397-401; Ladurner et al. (1997) J. Mol. Biol. 273:330-337; and U.S. Pat. No. 4,894,443.

In some examples, peptide linkers are encoded by nucleic acid and incorporated between the B-chain and A-chain upon expression in a host cell, such as *E. coli* or *S. cerevisiae*. In other examples, a peptide linker is synthesized by chemical methods. This can be performed in a separate protocol to the synthesis of one or more of the A- and B-chain, after which the components are joined, such as with the use of heterobifunctional linkers. Alternatively, a peptide linker can be synthesized at the N- or C-terminus of one of the insulin chains, which is then linked to the other chain via the peptide linker, such as with a heterobifunctional linker.

Any linker known to those of skill in the art can be used herein to link the insulin A-chain and B-chain. Linkers and linkages that are suitable for chemically linking the chains include, but are not limited to, disulfide bonds, thioether bonds, hindered disulfide bonds, and covalent bonds between free reactive groups, such as amine and thiol groups. These bonds are produced using heterobifunctional reagents to produce reactive thiol groups on one or both of the polypeptides and then reacting the thiol groups on one polypeptide with reactive thiol groups or amine groups to which reactive maleimido groups or thiol groups can be attached on the other. Other linkers include, acid cleavable linkers, such as bismaleimideothoxy propane, acid labile-transferrin conjugates and adipic acid diihydrazide, that would be cleaved in more acidic intracellular compartments; cross linkers that are cleaved upon exposure to UV or visible light and linkers, such as the various domains, such as CH1, CH2, and CH3, from the constant region of human IgG1 (see, Batra et al. (1993) *Molecular Immunol.* 30:379-386). In some embodiments, several linkers can be included in order to take advantage of desired properties of each linker. Chemical linkers and peptide linkers can be inserted by covalently coupling the linker to the insulin A-chain and B-chain. The heterobifunctional agents, described below, can be used to effect such covalent coupling. Peptide linkers also can be linked by expressing DNA encoding the linker between the B-chain and A-chain.

Other linkers that can be used to join the A-chain and B-chain of insulin include: enzyme substrates, such as cathepsin B substrate, cathepsin D substrate, trypsin substrate, thrombin substrate, subtilisin substrate, Factor Xa substrate, and enterokinase substrate; linkers that increase solubility, flexibility, and/or intracellular cleavability include linkers, such as $(gly_m ser)_n$ and $(ser_m gly)_n$, in which m is 1 to 6, preferably 1 to 4, more preferably 2 to 4, and n is 1 to 30, preferably 1 to 10, more preferably 1 to 4 (see, e.g., International PCT application No. WO 96/06641, which provides exemplary linkers). In some embodiments, several linkers can be included in order to take advantage of desired properties of each linker.

3. Expression

Insulin and hyaluronan degrading enzyme polypeptides can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Soluble hyaluronidase polypeptides also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreotol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda*, *Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-$\zeta$ and Fc$_\epsilon$RI-$\gamma$ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NSO (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO—S cells (Invitrogen, Carlsbad, Calif., cat #11619-012) and the serum free EBNA-1 cell line (Pham et al., (2003) *Biotechnol. Bioeng.* 84:332-42). Cell lines also are available that are adapted to grow in special mediums optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

4. Purification Techniques

Method for purification of polypeptides, including insulin and hyaluronan degrading enzyme polypeptides or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as insulin polypeptides or hyaluronan degrading enzyme polypeptides, can be purified using standard protein purification techniques known in the art including but not limited to, SDS-PAGE, size fractionation and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind hyaluronidase enzymes can be used in affinity purification. Expression constructs also can be engineered to add an affinity tag to a protein such as a myc epitope, GST fusion or $His_6$ and affinity purified with myc antibody, glutathione resin and Ni-resin, respectively. Purity can be assessed by any method known in the art including gel electrophoresis, orthoganal HPLC methods, staining and spectrophotometric techniques.

F. Preparation, Formulation and Administration of Insulin and Hyaluronan Degrading Enzyme Polypeptides Pharmaceutical compositions of fast-acting insulin and hyaluronan degrading enzymes are provided herein for administration. Hyaluronan degrading enzymes are co-formulated or co-administered with pharmaceutical formulations of fast-acting insulin to enhance the delivery of fast-acting insulin to the blood by increasing the rate of absorption and increasing the bioavailability of insulin. Increased rate of absorption and bioavailability can be achieved, for example, by reversible depolymerization of hyaluronan by the hyaluronan degrading enzyme, which temporarily (typically for a period of less than 24 hours) increases the hydraulic conductivity of the subcutaneous space. Thus, hyaluronan degrading enzymes can be used to achieve elevated and/or more rapidly achieved concentrations of the insulin following parenteral, such as, for example, subcutaneous, administration compared to conventional methods of subcutaneous administration, to provide, for example, a more potent and/or more rapid response for a given dose. Co-administration of a hyaluronan degrading enzyme with a fast-acting insulin, therefore, can render the fast-acting insulin a super fast-acting insulin. The hyaluronan degrading enzymes also can be used to achieve glycemic control with a lower dose of administered insulin. The ability of hyaluronan degrading enzymes to enhance bulk fluid flow at and near a site of injection or infusion also can improve other aspects of associated pharmacologic delivery. For example, the increase in bulk fluid flow can help to allow the volume of fluid injected to be more readily dispersed from the site of injection (reducing potentially painful or other adverse consequences of injection). This is particularly important for subcutaneous infusions to permit higher doses to be administered.

Thus, by virtue of the increased rate of absorption, parenterally-administered fast-acting insulins, can become super fast-acting insulins when administered with a hyaluronan degrading enzyme. The advantages over administration of insulin without a hyaluronan degrading enzyme is that co-administered or co-formulated hyaluronan degrading enzyme/insulin can result in more favorable dosing regimens, for example, lower insulin doses and/or the use of more effective closed loop systems, and improved therapeutic effects, for example, more efficient glycemic control and/or reduced excess insulin. For example, by lowering the dose, side effects associated with excess circulating insulin, such as observed with higher doses of insulin, can be reduced. Such side effects include, but are not limited to, hypoglycemia and obesity.

The compositions can be formulated in lyophilized or liquid form. Where the compositions are provided in lyophilized form they can be reconstituted just prior to use by an appropriate solution, for example, a sterile saline solution or sterile water for injection. The compositions can be provided together or separately. For example, the fast-acting insulin and hyaluronan degrading enzyme can be co-formulated in a single composition, or can be provided as separate compositions. When provided as separate compositions, the hyaluronan degrading enzyme and insulin can be packaged for administration together, sequentially or intermittently. The combinations can be packaged as a kit.

1. Formulations

The compounds can be formulated into any suitable pharmaceutical preparations for parenteral administration such as solutions, suspensions, sustained release formulations, or powders. Typically, the compounds are formulated into pharmaceutical compositions using techniques and procedures well known in the art (see e.g., Ansel *Introduction to Pharmaceutical Dosage Forms*, Fourth Edition, 1985, 126). Pharmaceutically acceptable compositions are prepared in view of approvals from a regulatory agency or other agency prepared in accordance with generally recognized pharmacopeia for use in animals and in humans. The formulation should suit the mode of administration.

Pharmaceutical compositions can include carriers such as a diluent, adjuvant, excipient, or vehicle with which a hyaluronan degrading enzyme and insulin is administered. Examples of suitable pharmaceutical carriers are described in "Remington's Pharmaceutical Sciences" by E. W. Martin. Such compositions will contain a therapeutically effective amount of the compound, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a bulking agent such as lactose, sucrose, dicalcium phosphate, or carboxymethylcellulose; a lubricant, such as magnesium stearate, calcium stearate and talc; and a binder such as starch, natural gums, such as gum acaciagelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, glycerin, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, glycerin, cyclodextrine derivatives, sorbitan monolaurate, triethanolamine sodium acetate, triethanolamine oleate, and other such agents.

Pharmaceutical therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Examples of unit dose forms include ampoules and syringes and individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, cartridges, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from a non-toxic carrier can be prepared.

Compositions provided herein typically are formulated for administration by subcutaneous route, although other routes of administration are contemplated, such as any route known to those of skill in the art including intramuscular, intraperitoneal, intravenous, intradermal, intralesional, intraperitoneal injection, epidural, vaginal, rectal, local, otic, transdermal administration or any route. Formulations suited for such routes are known to one of skill in the art. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition.

The most suitable route in any given case depends on a variety of factors, such as the nature of the disease, the tolerance of the subject to a particular administration route, the severity of the disease, and the particular composition that is used. Typically, the compositions provided herein are administered parenterally. In some examples, hyaluronan degrading enzymes are administered so that they reach the interstitium of skin or tissues, thereby degrading the interstitial space for subsequent delivery of insulin. Thus, in some examples, direct administration under the skin, such as by subcutaneous administration methods, is contemplated. Thus, in one example, local administration can be achieved by injection, such as from a syringe or insulin pen or other article of manufacture containing an injection device such as a needle. In another example, local administration can be achieved by infusion, which can be facilitated by the use of a pump or other similar device. Other modes of administration also are contemplated. Pharmaceutical compositions can be formulated in dosage forms appropriate for each route of administration.

Subcutaneous administration, generally characterized by injection or infusion, is contemplated herein. Injectables can be prepared in conventional forms, either as liquid solutions or suspensions, solid forms suitable for solution or suspension in liquid prior to injection, or as emulsions. Suitable excipients are, for example, water, saline, dextrose, glycerol or ethanol. The pharmaceutical compositions can contain other minor amounts of non-toxic auxiliary substances such as wetting or emulsifying agents, pH buffering agents, stabilizers, solubility enhancers, and other such agents, such as for example, sodium acetate, sodium phosphate, sorbitan monolaurate, triethanolamine oleate and cyclodextrins. In some examples, zinc, calcium, serum albumin, EDTA, calcium chloride and/or phenolic preservatives are included in the compositions. The percentage of active compound contained in such compositions is highly dependent on the specific nature thereof, as well as the activity of the compound and the needs of the subject.

Injectables are designed for local and systemic administration. For purposes herein, local administration is desired for direct administration to the affected interstitium. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions can be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcelluose, hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

The concentration of the pharmaceutically active compound is adjusted so that an injection or infusion provides an effective amount to produce the desired pharmacological effect, such as glycemic control. The exact dose depends on the age, weight and condition of the patient or animal as is known in the art. The unit-dose parenteral preparations can be packaged in, for example, an ampoule, a cartridge, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art.

In one example, pharmaceutical preparation can be in liquid form, for example, solutions, syrups or suspensions. If provided in liquid form, the pharmaceutical preparations can be provided as a concentrated preparation to be diluted to a therapeutically effective concentration before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

The fast-acting insulin and hyaluronan degrading enzyme compositions can be co-formulated as a single composition, or can be provided as two separate compositions. When provided as two compositions, the compositions can be mixed prior to administration to be co-administered, or can be kept separated and then co-administered together, sequentially or intermittently. In some examples, the fast-acting insulin and hyaluronan degrading enzyme are co-formulated as super fast-acting insulin compositions. As discussed below, the compositions can be formulated for single or multiple dosage, wherein the dosages can be provided as a ratio of amount of a hyaluronan degrading enzyme to insulin administered. For example, a hyaluronan degrading enzyme can be administered at 1 hyaluronidase U/insulin U (1:1) to 50:1 or more, for example, at or about 1:1, 2:1, 3:1, 4:1, 5:1, 6:1, 7:1, 8:1, 9:1, 10:1, 11:1, 12:1, 13:1, 14:1, 15:1, 20:1, 25:1, 30:1, 35:1, 40:1, 45:1, 50:1 or more. In other examples, lower ratios of hyaluronan degrading enzyme to insulin are administered, including, for example, 1 hyaluronidase U/2 insulin U (1:2), 1:3, 1:4, 1:5, 1:6, 1:7, 1:8, 1:9, 1:10, 1:15 or 1:20. The fast-acting insulin can be present in the co-formulated or separate compositions in concentrations of or about 10 U/mL, 20 U/mL, 30 U/mL, 40 U/mL, 50 U/mL, 60 U/mL, 70 U/mL, 80 U/mL, 90 U/mL, 100 U/mL, 150 U/mL, 200 U/mL, 250 U/mL, 300 U/mL, 350 U/mL, 400 U/mL, 450 U/ml or 500 U/mL. Typically, the amount of hyaluronan degrading enzyme in the co-formulated or separate compositions is functionally equivalent to or to at least 1 U/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL or 25 U/mL of hyaluronidase activity. In some examples, the amount of hyaluronan degrading enzyme in the co-formulated or separate compositions is functionally equivalent to or to at least 30 or 35 U/mL of hyaluronidase activity, such as or 30 U/mL, 35 U/mL, 37.5 U/mL, 40 U/mL, 50 U/mL, 60 U/mL, 70 U/mL, 80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/ml, 2000 U/mL, 3000 U/mL or 5000 U/mL of hyaluronidase activity.

The super fast-acting insulin compositions provided herein can contain one or more pH buffers (such as, for example, histidine, phosphate, Tris or other buffers), or acidic buffer (such as acetate, citrate, pyruvate, Gly-HCl, succinate, lactate, maleate or other buffers), tonicity modifier (such as, for example, an amino acid, polyalcohol, glycerol, NaCl, trehalose, other salts and/or sugars), stabilizer (such as sodium benzoate to stabilize insulin), chelating agent, such as ethylenediaminetetraacetic acid, ethylenediaminetetraacetate or calcium EDTA, oxygen scavenger, such as methionine, ascorbic acid/ascorbate, citric acid/citrate, or albumin, and/or a preservative, such as preservative containing an aromatic ring (e.g. phenol or cresol). Exemplary preservatives that are useful in the compositions provided herein include, but are not limited to, m-cresol, phenol and paraben or any combination thereof. In some examples, m-cresol is added at or approximately 0.05% to 0.2%, such as 0.1% to 0.15% (e.g. at or about 0.1%, 0.11%, 0.12%, 0.13%, 0.14% or 0.15%). Suitable concentrations of phenol or paraben include 0.05-0.25%, such as 0.1% to 0.2% (e.g. at or about 0.1%, 0.12%, 0.13%, 0.14%, 0.15%, 0.16%, 0.17%, 0.18%, 0.19% and 0.2%). Typically, NaCl or other salt is provided in compositions containing a hyaluronan degrading enzyme. Exemplary concentrations of NaCl include 50 mM to 200 mM, such as 50 mM to 150 mM, including 50 mM, 60 mM, 70 mM, 80 mM, 90 mM, 100 mM, 120 mM, 130 mM, 140 mM and 150 mM NaCl. In some examples, to retain the stability of the compositions provided herein, as the salt concentration in the composition is increased, so too is the pH. Glycerol also can be included as a tonicity modifier and/or to increase the viscosity of the compositions.

Exemplary stabilizers that are useful for compositions containing a hyaluronan degrading enzyme include detergents or surfactants, such as polysorbates and proteins such as human serum albumin. In some examples, one or more surfactants (e.g. such as Pluronic F68) are included in the compositions, such as at or about 0.001% to 0.1%, typically at or about 0.005% to 0.03% (e.g. 0.005%, 0.006%, 0.007%, 0.008%, 0.009%, 0.01%, 0.012%, 0.014%, 0.016%, 0.018%, 0.02% or 0.03. Exemplary concentrations of serum albumin that are useful in the compositions herein include 0.1 mg/mL, 0.2 mg/mL, 0.3 mg/mL, 0.4 mg/mL, 0.5 mg/mL, 0.6 mg/mL, 0.7 mg/mL, 0.8 mg/mL, 0.9 mg/mL or 1 mg/mL, but can be more or less. Polysorbates also can be present in the compositions at, for example, concentrations of or about 0.001%, 0.002%, 0.003%, 0.004%, 0.005%, 0.006%, 0.007%, 0.008%, 0.009%, 0.01%, 0.02%, 0.03%, 0.04%, 0.05%, 0.06%, 0.07%, 0.08%, 0.09% or 0.1%. Exemplary stabilizers that are useful for compositions containing an insulin include zinc and m-cresol. For example, zinc can function to stabilize the insulin hexamer. Zinc can be provided, for example, as zinc oxide, zinc acetate or zinc chloride. Zinc can be present in a composition provided herein at between or about 0.001 to 0.1 mg per 100 units of insulin, such as 0.002 milligrams per 100 units of insulin (mg/100 U), 0.005 mg/100 U, 0.001 mg/100 U, 0.012 mg/100 U, 0.014 mg/100 U, 0.016 mg/100 U, 0.017 mg/100 U, 0.018 mg/100 U, 0.02 mg/100 U, 0.022 mg/100 U, 0.024 mg/100 U, 0.026 mg/100 U, 0.28 mg/100 U, 0.03 mg/100 U, 0.04 mg/100 U, 0.05 mg/100 U, 0.06 mg/100 U, 0.07 mg/100 U, 0.08 mg/100 U or 0.1 mg/100 U. In one example, zinc is present at 0.017 mg per 100 U insulin. A metal chelating agent, such as calcium EDTA (CaEDTA), also can be present, such as for example, at concentrations of between approximately 0.02 mM to 20 mM, such as 0.02 mM, 0.04 mM, 0.06 mM, 0.08 mM, 0.1 mM, 0.2 mM, 0.3 mM, 0.4 mM, 0.5 mM, 0.6 mM, 0.7 mM, 0.8 mM, 0.9 mM, 1 mM, 5 mM, 10 mM, 15 mM, 20 mM or more. In some examples, when both a chelating agent and zinc are present in a composition provided herein, the chelating agent is present in approximately equal amounts (i.e. 0.6 to 1.4 molar ratio) or molar excess to zinc, such as for example, at a ratio of or about 2:1, 5:1, 10:1, 20:1, 30:1, 40:1, 50:1, 60:1, 70:1, 80:1, 90:1, 100:1 or more chelating agent:zinc. Calcium chloride also can be included in the compositions at, for example, between about 0.2 mM to 20 mM.

In some instances, any one or more of the components described above are present in only the fast-acting insulin composition or the hyaluronan degrading composition, until the two compositions are either co-formulated or delivered to the subject as a super fast-acting insulin composition. For example, the fast-acting insulin composition can contain zinc at between or about 0.001 to 0.1 mg per 100 units of insulin, such as 0.002 milligrams per 100 units of insulin (mg/100 U), 0.005 mg/100 U, 0.01 mg/100 U, 0.012 mg/100 U, 0.014 mg/100 U, 0.016 mg/100 U, 0.017 mg/100 U, 0.018 mg/100 U, 0.02 mg/100 U, 0.022 mg/100 U, 0.024 mg/100 U, 0.026 mg/100 U, 0.28 mg/100 U, 0.03 mg/100 U, 0.04 mg/100 U, 0.05 mg/100 U, 0.06 mg/100 U, 0.07 mg/100 U, 0.08 mg/100 U or 0.1 mg/100 U and no chelating agent, such as EDTA, while the hyaluronan degrading composition can contain a chelating agent, such as EDTA, at or about 0.02 mM to 20 mM, such as 0.02 mM, 0.04 mM, 0.06 mM, 0.08 mM, 0.1 mM, 0.2 mM, 0.3 mM, 0.4 mM, 0.5 mM, 0.6 mM, 0.7 mM, 0.8 mM, 0.9 mM, 1 mM, 5 mM, 10 mM, 15 mM, 20 mM or more and no zinc. Thus, it is only when the two compositions are mixed, such as when being co-formulated or co-administered, that the composition containing insulin also contains EDTA, and the composition containing a hyaluronan degrading enzyme also contains zinc. In some instances, the initial fast-acting insulin composition and hyaluronan degrading enzyme composition contain sufficient amounts of zinc or chelating agent, respectively, that when mixed for co-formulation or co-administration, the chelating agent is present in approximately equimolar amounts (i.e. 0.6 to 1.4 molar ratio) or molar excess to zinc, such as for example, at a ratio of or about 2:1, 5:1, 10:1, 20:1, 30:1, 40:1, 40:1, 50:1, 60:1, 70:1, 80:1, 90:1, 100:1 or more chelating agent:zinc.

The pH and the osmolarity of the compositions can be adjusted by one of skill in the art to optimize the conditions for the desired activity and stability of the composition. For example, as noted above, in some instances, if the salt concentration is increased, the pH also can be increased to retain stability of the composition. Further, one of skill in the art can change the pH to increase solubility of the particular fast-acting insulin used in the super fast-acting insulins provided herein. In some examples, the compositions provided herein that contain one or both of a fast-acting insulin and a hyaluronan degrading enzyme have an osmolarity of at or about 100 mOsm/kg, 120 mOsm/kg, 140 mOsm/kg, 160 mOsm/kg, 180 mOsm/kg, 200 mOsm/kg, 220 mOsm/kg, 240 mOsm/kg, 260 mOsm/kg, 280 mOsm/kg, 300 mOsm/kg, 320 mOsm/kg, 340 mOsm/kg, 360 mOsm/kg, 380 mOsm/kg, 400 mOsm/kg, 420 mOsm/kg, 440 mOsm/kg, 460 mOsm/kg, 500 or more mOsm/kg, and a pH of at or about 6, 6.2, 6.4, 6.6, 6.8, 7, 7.2, 7.4, 7.6, 7.8 or 8. In some examples, the pH from or from about 6.5 to or to about 7.5, such as 6.5, 6.6, 6.7, 6.8, 6.9, 7.0, 7.1, 7.2, 7.3, 7.4 or 7.5.

Administration methods can be employed to decrease the exposure of selected compounds to degradative processes, such as proteolytic degradation and immunological intervention via antigenic and immunogenic responses. Examples of such methods include local administration at the site of treatment. Pegylation of therapeutics has been reported to increase resistance to proteolysis, increase plasma half-life, and decrease antigenicity and immunogenicity. Examples of pegylation methodologies are known in the art (see for example, Lu and Felix, *Int. J. Peptide Protein Res.*, 43: 127-138, 1994; Lu and Felix, *Peptide Res.*, 6: 142-6, 1993; Felix et al., *Int. J. Peptide Res.*, 46: 253-64, 1995; Benhar et al., *J. Biol. Chem.*, 269: 13398-404, 1994; Brumeanu et al., *J Immunol.*, 154: 3088-95, 1995; see also, Caliceti et al. (2003) *Adv. Drug Deliv. Rev.* 55(10):1261-77 and Molineux (2003) *Pharmacotherapy* 23 (8 Pt 2):3S-8S). Pegylation also can be used in the delivery of nucleic acid molecules in vivo. For example, pegylation of adenovirus can increase stability and gene transfer (see, e.g., Cheng et al. (2003) *Pharm. Res.* 20(9): 1444-51).

Lyophilized Powders

Of interest herein are lyophilized powders, which can be reconstituted for administration as solutions, emulsions and other mixtures. They also can be reconstituted and formulated as solids or gels.

The sterile, lyophilized powder is prepared by dissolving an active compound in a buffer solution. The buffer solution can contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbital, fructose, corn syrup, xylitol, glycerin, glucose, sucrose or other suitable agent, in a suitable buffer, such as citrate, Tris, histidine, sodium or potassium phosphate or other such buffer known to those of skill in the art. Then, a selected enzyme is added to the resulting mixture, and stirred until it dissolves. The resulting mixture is sterile filtered or treated to remove particulates and to insure sterility, and apportioned into vials for lyophilization. Each vial will contain a single dosage or multiple dosages of the compound. The lyophilized powder can be stored under appropriate conditions, such as at about 4° C. to room temperature. Reconstitution of this lyophilized powder with a buffer solution provides a formulation for use in parenteral administration.

2. Dosage and Administration

The hyaluronan degrading enzyme provided herein can be formulated as pharmaceutical compositions for single dosage or multiple dosage administration. For example, the compositions provided herein can contain hyaluronan degrading enzyme at 1 hyaluronidase U/insulin U (1:1) to 50:1 or more, for example, at or about 1:1, 2:1, 3:1, 4:1, 5:1, 6:1, 7:1, 8:1, 9:1, 10:1, 11:1, 12:1, 13:1, 14:1, 15:1, 20:1, 25:1, 30:1, 35:1, 40:1, 45:1, 50:1 or more. In other examples, lower ratios of hyaluronan degrading enzyme to insulin are provided in the compositions, including, for example, 1 hyaluronidase U/2 insulin U (1:2), 1:3, 1:4, 1:5, 1:6, 1:7, 1:8, 1:9, 1:10, 1:15 or 1:20. The selected hyaluronan degrading enzyme is included in an amount sufficient to exert a therapeutically useful effect in the absence of undesirable side effects on the patient treated. The therapeutically effective concentration can be determined empirically by testing the polypeptides in known in vitro and in vivo systems such as by using the assays provided herein or known in the art (see e.g., Taliani et al. (1996) Anal. Biochem., 240: 60-67; Filocamo et al. (1997) J Virology, 71: 1417-1427; Sudo et al. (1996) Antiviral Res. 32: 9-18; Buffard et al. (1995) Virology, 209:52-59; Bianchi et al. (1996) Anal. Biochem., 237: 239-244; Hamatake et al. (1996) Intervirology 39:249-258; Steinkuhler et al. (1998) Biochem., 37:8899-8905; D'Souza et al. (1995) J. Gen. Virol., 76:1729-1736; Takeshita et al. (1997) Anal. Biochem., 247: 242-246; see also e.g, Shimizu et al. (1994) J. Virol. 68:8406-8408; Mizutani et al. (1996) J. Virol. 70:7219-7223; Mizutani et al. (1996) Biochem. Biophys. Res. Commun., 227:822-826; Lu et al. (1996) Proc. Natl. Acad. Sci. (USA), 93:1412-1417; Hahm et al., (1996) Virology, 226:318-326; Ito et al. (1996) J. Gen. Virol., 77:1043-1054; Mizutani et al. (1995) Biochem. Biophys. Res. Commun., 212:906-911; Cho et al. (1997) J. Virol. Meth. 65:201-207) and then extrapolated therefrom for dosages for humans.

Therapeutically effective dosages for the super fast-acting insulin compositions containing a fast-acting insulin and a hyaluronan degrading enzyme can be determined based upon, for example, pharmacokinetic (PK) data and pharmacodynamic (PD) data, such as described below and in Example 1, and the known therapeutic doses of the fast-acting insulin when delivered without a hyaluronan degrading enzyme. Changes in insulin concentration in blood or plasma or serum with time provides information on in vivo (1) absorption for parenteral administration; (2) distribution, and (3) elimination of insulin. A pharmacokinetic model defines these physi ological changes in the concentration of insulin as a function of time $$\left(\text{that is, } \frac{(dX)}{(dt)}\right)$$

and characterizes them mathematically using rates and volumes. The model parameters thus derived for insulin will remain relatively constant until a perturbation occurs. A well established PK model for insulin can provide reasonable predictions of exposure (which is closely related to efficacy and for drug safety that results from exaggerate pharmacology). Clinical decisions on dose selection and dose schedule of insulin can be facilitated and justified using PK modeling and simulations. A pharmacodynamic model serves a similar purpose for prediction of clinical outcome.

Typically, a therapeutically effective dose of a hyaluronan degrading enzyme is at or about 0.3 Units (U) to 5,000 U of a hyaluronan degrading enzyme. For example, a hyaluronan degrading enzyme can be administered subcutaneously at or about 0.3 U, 0.5 U, 1 U, 2 U, 3 U, 5 U, 10 U, 20 U, 30 U, 40 U, 50 U, 100 U, 150 U, 200 U, 250 U, 300 U, 350 U, 400 U, 450 U, 500 U, 600 U, 700 U, 800 U, 900 U, 1000 U, 2,000 U, 3,000 U, 4,000 Units, 5,000 U or more. In some examples, dosages can be provided as a ratio of amount of a hyaluronan degrading enzyme to insulin administered. For example, a hyaluronan degrading enzyme can be administered at 1 hyaluronidase U/insulin U (1:1) to 50:1 or more, for example, at or about 1:1, 2:1, 3:1, 4:1, 5:1, 6:1, 7:1, 8:1, 9:1, 10:1, 11:1, 12:1, 13:1, 14:1, 15:1, 20:1, 25:1, 30:1, 35:1, 40:1, 45:1, 50:1 or more. In other examples, lower ratios of hyaluronan degrading enzyme to insulin are administered, including, for example, 1 hyaluronidase U/2 insulin U (1:2), 1:3, 1:4, 1:5, 1:6, 1:7, 1:8, 1:9, 1:10, 1:15 or 1:20. Typically, volumes of injections or infusions of hyaluronan degrading enzyme contemplated herein are from at or about 0.01 mL, 0.05 mL, 0.1 mL, 0.2 mL, 0.3 mL, 0.4 mL, 0.5 mL, 1 mL, 2 mL, 3 mL, 4 mL, 5 mL, 6 mL, 7 mL, 8 mL, 9 ml, 10 ml or more. The hyaluronan degrading enzyme can be provided as a stock solution at or about 1 U/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL, 25 U/mL, 30 U/mL, 35 U/mL, 40 U/mL, 50 U/mL, 60 U/mL, 70 U/mL, 80 U/mL, 90 U/mL 100 U/ml, 150 U/ml, 200 U/ml, 300 U/ml, 400 U/ml, 500 U/mL, 600 U/mL, 800 U/mL or 1000 U/mL, or can be provided in a more concentrated form, for example at or about 2000 U/ml, 3000 Units/ml, 4000 U/ml, 5000 U/ml, 8000 U/ml, 10,000 U/mL or 20,000 U/mL for use directly or for dilution to the effective concentration prior to use. The hyaluronan degrading enzyme can be provided as a liquid or lyophilized formulation.

The insulin preparations provided herein can be formulated as pharmaceutical compositions for single or multiple dose use. For example, in some instances, insulin preparations are formulated for single dose administration in an amount sufficient to provide post-prandial glycemic control. In other examples, insulin preparations are formulated for multiple dose administration or multi use vials, such as for use in an insulin pen, insulin pump or other continuous insulin delivery device, or closed loop system. The insulin preparations can be provided in lyophilized or liquid form as discussed elsewhere herein.

The insulin can be provided in a therapeutically effective dose. Therapeutically effective doses can be determined empirically by testing the compounds in known in vitro and in vivo systems, such as the assays provided herein, and also can be individualized for each subject based upon such factors as metabolism, food intake and severity of the disease. The concentration of a selected insulin in the composition depends on, for example, absorption, inactivation and excretion rates of the complex, the physicochemical characteristics of the complex, the dosage schedule, and amount administered as well as other factors known to those of skill in the art. For example, it is understood that the precise dosage of treatment is a function of the blood glucose levels in a subject, and can be determined empirically using known algorithms or by extrapolation from in vivo or in vitro test data, past experience of the subject, carbohydrate counting to determine the carbohydrate content in a meal and, therefore, the estimated prandial blood glucose increase and subsequent requirement for insulin. It is to be noted that concentrations and dosage values can vary with each subject treated. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof. The amount of a selected insulin preparation to be administered for the treatment of a diabetic condition can be determined by standard clinical techniques. In addition, in vitro assays and animal models can be employed to help identify optimal dosage ranges.

Hence, the precise dosage, which can be determined empirically, can depend on the particular insulin preparation, the regime and dosing schedule with hyaluronan degrading enzyme, the route of administration, the type of diabetes to be treated, the seriousness of the disease and the subject being treated. Generally, insulin is provided in an amount that achieves glycemic control. For example, to achieve post prandial glycemic control, diabetic subjects typically are administered a bolus injection of or about 0.05 U of fast-acting insulin per kg body weight (U/kg) to 1.0 U/kg 30 minutes to 5 minutes prior to a meal, when insulin is delivered without a hyaluronan degrading enzyme. It is understood that this dose can be increased or decreased as appropriate based upon, for example, the metabolism of a particular subject, the content of the meal, and blood glucose levels. It is further understood that the time at which the insulin is delivered for post prandial glycemic control can be changed to be closer to or further from the time of ingestion of a meal, and, in some cases, can be changed such that the insulin is delivered at the time of the meal or after the meal. A subject can, therefore, be administered a super fast-acting insulin composition provided herein by administering an insulin, such as a fast-acting insulin, in combination with a hyaluronan degrading enzyme, at a dose lower than that administered when insulin is administered alone and/or at a time closer to ingestion of a meal compared to the time at which the insulin alone dose is typically administered.

Fast-acting insulins typically are administered at doses of between 0.05 Units/kg to 0.25 Units/kg, such as, for example, 0.10 Units/kg, although the particular dose varies. Super fast-acting insulin compositions can be administered at lower doses compared to the fast-acting insulin administered in the absence of a hyaluronan degrading enzyme. As discussed elsewhere herein, the degree to which the amount of a fast-acting insulin can be lowered by administering it as a super fast-acting insulin composition varies, depending on, for example, the type of diabetes the patient has. Typically, the reduction in the amount of fast-acting insulin administered to Type 2 diabetic patients when administered as a super fast-acting insulin composition is greater than the reduction in the amount of fast-acting insulin administered to Type 1 diabetic patients when administered as a super fast-acting insulin composition. For example, in instances where a Type 1 diabetic patient and Type 2 diabetic patient are both administered 0.20 U/kg of fast-acting insulin to control postprandial glucose levels, the Type 1 diabetic patient can be administered 0.15 U/kg of fast-acting insulin in a super fast-acting insulin composition to achieve the same or better glycemic control, and the Type 2 diabetic patient can be administered 0.10 U/kg fast-acting insulin in a super fast-acting insulin composition to achieve the same or better glycemic control. Thus, in some examples, it is contemplated herein that the amount of a fast-acting insulin that is administered with a hyaluronan degrading enzyme as a super fast-acting insulin to a Type 2 diabetic patient to achieve glycemic control can be reduced by, for example, 25%, 30%, 35%, 40%, 45%, 50%, 55%, 60%, 65%, 70%, 75%, 80% or more compared to the amount required for glycemic control when administered without a hyaluronan degrading enzyme, and the amount of a fast-acting insulin that is administered with a hyaluronan degrading enzyme as a super fast-acting insulin composition to a Type 1 diabetic patient to achieve glycemic control can be reduced by, for example, 10%, 15%, 20%, 25%, 30%, 35%, 40%, 45%, 50%, 55%, 60%, 65%, 70% or more compared to the amount required for glycemic control when administered without a hyaluronan degrading enzyme.

Exemplary dosage ranges for parenteral, such as subcutaneous, administration of insulin using the methods and compositions provided herein to control postprandial blood glucose levels are from at or about 0.05 U/kg to 0.50 U/kg, such as 0.05 U/kg, 0.06 U/kg, 0.07 U/kg, 0.08 U/kg, 0.09 U/kg, 0.10 U/kg, 0.11 U/kg, 0.12 U/kg, 0.13 U/kg, 0.14 U/kg, 0.15 U/kg, 0.20 U/kg, 0.25 U/kg, 0.30 U/kg, 0.40 U/kg, 0.50 U/kg or 1.0 U/kg. The particular dosage and formulation thereof depends upon the disease and individual. If necessary dosage can be empirically determined. To achieve such dosages, volumes of insulin preparations administered subcutaneously to control postprandial glucose levels can be at or about 10 µL, 20 µL, 30 µL, 40 µL, 50 µL, 75 µL, 100 µL, 150 µL, 200 µL, 250 µL, 300 µL, 400 µL, 500 µL, 600 µL, 700 µL, 800 µL, 900 µL, 1000 µL or more. For example, a 100 U/mL insulin formulation for indications described herein can be subcutaneously administered to a 70 kg subject in a volume of 35 µL to 350 µL to achieve a dosage of 0.05 U/kg to 0.50 U/kg of insulin. The compositions and methods provided herein also can be administered to diabetic subjects to effect glycemic control throughout the day and night, in addition to postprandial glycemic control. Typically, dosages of insulin administered to provide continuous glycemic control are less than those required to achieve postprandial glycemic control. Dosages can, however, be increased or decreased based on blood glucose levels. Exemplary dosage ranges for parenteral, such as subcutaneous, administration of insulin using the methods and compositions provided herein to provide continuous glycemic control are from at or about 0.001 U/kg to 0.30 U/kg, such as 0.001 U/kg, 0.005 U/kg, 0.01 U/kg, 0.02 U/kg, 0.05 U/kg to 0.30 U/kg, such as 0.05 U/kg, 0.06 U/kg, 0.07 U/kg, 0.08 U/kg, 0.09 U/kg, 0.10 U/kg, 0.11 U/kg, 0.12 U/kg, 0.13 U/kg, 0.14 U/kg, 0.15 U/kg, 0.20 U/kg, 0.25 U/kg, 0.30 U/kg, 0.40 U/kg, 0.50 U/kg or 1.0 U/kg. The particular dosage and formulation thereof depends upon the disease, the time of administration, and the individual. If necessary dosage can be empirically determined. The dosage for an individual is typically titrated down to the minimal dosage required to achieve a therapeutic effect, such as the minimal dosage required to achieve glycemic control. The amount of insulin sufficient to achieve glycemic control can be determined empirically, such as by glucose challenge.

The hyaluronan degrading enzyme can be administered prior, subsequently, intermittently or simultaneously to the insulin preparation. Generally, the hyaluronan degrading enzyme is administered prior to or simultaneously with administration of the insulin preparation to permit the hyaluronan degrading enzyme to degrade the hyaluronic acid in the interstitial space. In one example, the insulin composition and hyaluronan degrading enzyme composition are co-formulated and, therefore, administered simultaneously. In another example, the hyaluronan degrading enzyme composition is administered prior to the insulin composition, such as 1 minute, 2 minutes, 3 minutes, 4 minutes, 5 minutes or more prior to administration of the insulin preparation. In some examples, the hyaluronidase is administered together with the insulin preparation. As will be appreciated by those of skill in the art, the desired proximity of co-administration can be readily optimized by testing the effects of administering the agents at varying times in suitable models, such as in suitable animal models.

Both the insulin preparation and the hyaluronan degrading enzyme preparation can be administered at once, or can be divided into a number of smaller doses to be administered at intervals of time. Selected insulin preparations can be administered in one or more doses over the course of a treatment time for example over several minutes, hours, days, weeks, or months. In some cases, continuous administration is useful. It is understood that the precise dosage and course of administration depends on the indication and patient's tolerability.

Also, it is understood that the precise dosage and duration of treatment is a function of the diabetes being treated and can be determined empirically using known testing protocols or by extrapolation from in vivo or in vitro test data. It is to be noted that concentrations and dosage values also can vary with the severity of the diabetes and other factors, such as metabolism, food intake, and body weight of the subject. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered every minute, every several minutes, hourly, daily, weekly, monthly, yearly or once, depending upon the subject and the diabetic state. Generally, dosage regimens are chosen to limit toxicity and/or other negative effects, such as excess insulin. It should be noted that the attending physician would know how to and when to terminate, interrupt or adjust therapy to lower dosage. Conversely, the attending physician would also know how to and when to adjust treatment to higher levels if the clinical response is not adequate (precluding toxic side effects).

Mode of Administration a. Syringes

The compositions provided herein can be parentally administered to a subject using one or more of several modes of administration, including, but not limited to, syringes, insulin pens, insulin pumps, or in the context of a closed loop system or any combination thereof. For example, single-use syringes, including insulin syringes, can be used to administer discrete bolus injections of the compositions. The compositions can be administered using the same syringe, such as when the insulin and hyaluronan degrading enzyme preparations are co-formulated, or can be administered sequentially using different syringes. Syringes useful for administrations of the compositions provided herein include insulin syringes, which can be designed to hold standard concentrations of insulin preparations, including 100 U/ml concentrations of insulin preparations, and have markings in insulin units for ease of administration. In other examples, any one or more of an insulin syringe or insulin pump or similar device is used to administer one or both of the insulin preparation and the hyaluronan degrading enzyme preparation.

b. Insulin Pen

An insulin pen is a delivery system that can be used to administer the compositions provided herein. Insulin pens include those with replaceable cartridges filled with the composition to be administered and those with non-replaceable cartridges. Insulin pens with non-replaceable cartridges are typically disposed of when the cartridge has been emptied. Insulin pens enable dosing in, for example, half unit, one unit or two unit increments, which are generally measured using a dosing dial or other mechanism to set the dose (see e.g. U.S. Pat. Nos. 5,947,934, 6,074,372, 6,110,149, 6,524,280, 6,582, 404). The composition is then delivered by way of a fine needle attached to the pen. Insulin pens are well known in the art and include those described elsewhere, including, but not limited to, those described in U.S. Pat. Nos. 5,947,934, 4,973, 318, 5,462,535, 5,599,323, 5,626,566, 5,984,906, 6,074,372, 6,110,149, 6,302,869, 6,379,339 and 7,241,278). Other similar dosing devices, such as for example, those described in U.S. Pat. Nos. 5,947,394, 6,074,372, 6,110,149 and 6,379, 339, also can be used to administer the compositions provided herein, either as a co-formulation of insulin and hyaluronan degrading enzyme or separately as an insulin composition and a hyaluronan degrading enzyme composition. In some examples, the insulin pen or similar device also contains a sensor or monitor than can measure the blood glucose level of the subject (see e.g. WO2003047426).

Insulin pens and similar delivery devices that can be used, or modified to be used, to deliver the insulin compositions provided herein are well known in the art and include, but are not limited to, those marketed under the trademarks Autopen® (Owen Mumford, Inc.), Disetronic Pen (Disetronic Medical Systems), Humalog® Pen (Eli Lilly and Company), Humalog® Mix 75/25 Pen (Eli Lilly and Company), Humulin® 70/30 Pen (Eli Lilly and Company), Humulin® N Pen (Eli Lilly and Company), Novolog® FlexPen (Novo Nordisk), NovoPen® 3 (Novo Nordisk), NovoPen® 4 (Novo Nordisk), NovoPen® Junior (Novo Nordisk), Novolog® Mix 70/30 FlexPen (Novo Nordisk), InDuo® (Novo Nordisk), Novolin® InnoLet® (Novo Nordisk), Innovo® (Novo Nordisk), OptiPen® (Sanofi-Aventis) OptiPen® Pro2 (Sanofi-Aventis), OptiSet® (Sanofi-Aventis) and SoloSTAR® (Sanofi-Aventis).

c. Insulin Pumps and Other Insulin Delivery Devices

The compositions provided herein can be administered to a diabetic subject using an insulin delivery device, such as an insulin pump or other similar continuous infusion device. Insulin delivery devices typically contain at least one disposable reservoir containing an insulin composition, a pump (including any controls, software, processing modules and/or batteries) and a disposable infusion set, including a cannula or needle for subcutaneous injection and a tube connecting the cannula or needle to the insulin reservoir. For use with a super fast-acting insulin composition, the insulin delivery device can contain one reservoir containing a co-formulated insulin and hyaluronan degrading enzyme compositions, or can contain one or more reservoirs, such that the fast-acting insulin and hyaluronan degrading enzyme compositions are contained in the same or separate reservoirs. In such instances, the insulin delivery device can deliver each composition simultaneously or subsequent to each other. Thus, such devices can be used to administer the super fast-acting insulin compositions provided herein. The compositions can be administered continuously or in bolus injections. Further, an insulin delivery device user has the ability to influence the profile of the insulin by shaping the bolus. For example, a standard bolus can be administered, which is an infusion similar to a discrete injection in that all of the dose is pumped immediately. An extended bolus is a slow infusion over time that avoids a high initial dose and extends the action of the composition. A combination bolus containing both a standard bolus and an extended bolus also can be administered using an insulin pump or other continuous delivery system. Insulin delivery devices are known in the art and described elsewhere, including, but not limited to, in U.S. Pat. Nos. 6,554, 798, 6,641,533, 6,744,350, 6,852,104, 6,872,200, 6,936,029, 6,979,326, 6,999,854, 7,025,713 and 7109878. Insulin delivery devices also can be connected to a glucose monitor or sensor, and/or can contain a means to calculate the recommended insulin dose based upon blood glucose levels, carbohydrate content of a meal, or other input. Further insulin delivery devices can be implantable or can be external to the subject.

d. Closed Loop Systems

Closed loop systems, sometimes referred to as an artificial pancreas, are of particular interest for use with the compositions and methods provided herein. Closed loop systems refer to systems with an integrated continuous glucose monitor, an insulin pump or other delivery system and controller that includes a mathematical algorithm that constantly calculates the required insulin infusion for glycemic control based upon real time measurements of blood glucose levels. Such systems, when optimized, can facilitate constant and very tight glycemic control, similar to the natural insulin response and glycemic control observed in a healthy non-diabetic subject. To be effective, however, closed loop systems require both a reliable and accurate continuous glucose monitor, and delivery of an insulin with a very fast action. For example, delays in insulin absorption and action associated with subcutaneous delivery of fast-acting insulins can lead to large postprandial glycemic excursions (Hovorka et al. (2006) Diabetic Med. 23:1-12). The delay because of insulin absorption, insulin action, interstitial glucose kinetics, and the transport time for ex vivo-based monitoring systems, such as those based on the microdialysis technique, can result in an overall 100 minute or more time lag from the time of insulin delivery to the peak of its detectable glucose-lowering effect (Hovorka et al. (2006) Diabetic Med. 23:1-12). Thus, once administered, insulin will continue to increase its measurable effect for nearly 2 hours. This can complicate effective lowering of glucose concentration following meal ingestion using a closed-loop system. First, a glucose increase has to be detected. However, this typically happens only after an approximate 10-40 minute lag. The system must determine that a meal has been digested and administer an appropriate insulin dose. The ability of the system to compensate subsequently for a 'misjudged' insulin dose is compromised by long delays and the inability to 'withdraw' insulin once administered. Such problems can, at least in part, be overcome by using a super fast-acting insulin composition, such as those provided herein, which exhibit an increased rate and level of absorption and an associated improvement in the pharmacodynamics (as described in Example 1, below). The super fast-acting insulin compositions provided herein have a reduced $t_{max}$ (i.e. achieve maximal concentration faster) than fast-acting insulins and begin controlling blood glucose levels faster than fast-acting insulins. This increased rate of absorbance and onset of action reduces the lag between insulin action and glucose monitoring and input, resulting in a more effective closed loop system that can more tightly control blood glucose levels, reducing glycemic excursions.

Closed loop systems are well known in the art and have been described elsewhere, including, but not limited to, U.S. Pat. Nos. 5,279,543, 5,569,186, 6,558,351, 6,558,345, 6,589,229, 6,669,663, 6,740,072, 7,267,665 and 7354420, which are incorporated by reference herein. These and similar systems, easily identifiable by one of skill in the art, can be used to deliver the super fast-acting insulin compositions provided herein. Closed loops systems include a sensor system to measure blood glucose levels, a controller and a delivery system. This integrated system is designed to model a pancreatic beta cell (β-cell), such that it controls an infusion device to deliver insulin into a subject in a similar concentration profile as would be created by fully functioning human β-cells when responding to changes in blood glucose concentrations in the body. Thus, the system simulates the body's natural insulin response to blood glucose levels and not only makes efficient use of insulin, but also accounts for other bodily functions as well since insulin has both metabolic and mitogenic effects. Further, the glycemic control achieved using a closed loop system is achieved without requiring any information about the size and timing of a meal, or other factors. The system can rely solely on real time blood glucose measurements. The glucose sensor generates a sensor signal representative of blood glucose levels in the body, and provides the sensor signal to the controller. The controller receives the sensor signal and generates commands that are communicated to the insulin delivery system. The insulin delivery system receives the commands and infuses insulin into the body in response to the commands. Provided below are descriptions of exemplary components of closed loop systems that can be used to deliver the super fast-acting insulin compositions provided herein. It is understood that one of skill in the art can readily identify suitable closed loop systems for use herein. Such systems have been described in the art, including but not limited to, those described in U.S. Pat. Nos. 5,279,543, 5,569,186, 6,558,351, 6,558,345, 6,589,229, 6,669,663, 6,740,072, 7,267,665 and 7,354,420. The individual components of the systems also have been described in the art, individually and in the context of a closed loops system for use in achieving glycemic control. It is understood that the examples provided herein are exemplary only, and that other closed loop systems or individual components can be used to deliver the super fast-acting insulin compositions provided herein.

Closed loop systems contain a glucose sensor or monitor that functions continuously. Such devices can contain needle-type sensors that are inserted under the skin and attached to a small transmitter that communicates glucose data wirelessly by radiofrequency telemetry to a small receiver. In some examples, the sensor is inserted through the subject's skin using an insertion needle, which is removed and disposed of once the sensor is positioned in the subcutaneous tissue. The insertion needle has a sharpened tip and an open slot to hold the sensor during insertion into the skin (see e.g. U.S. Pat. Nos. 5,586,553 and 5,954,643). The sensor used in the closed loop system can optionally contain three electrodes that are exposed to the interstitial fluid (ISF) in the subcutaneous tissue. The three electrodes include a working electrode, a reference electrode and a counter electrode that are used to form a circuit. When an appropriate voltage is supplied across the working electrode and the reference electrode, the ISF provides impedance between the electrodes. An analog current signal flows from the working electrode through the body and to the counter electrode. The voltage at the working electrode is generally held to ground, and the voltage at the reference electrode can be held at a set voltage Vset, such as, for example, between 300 and 700 mV. The most prominent reaction stimulated by the voltage difference between the electrodes is the reduction of glucose as it first reacts with the glucose oxidase enzyme (GOX) to generate gluconic acid and hydrogen peroxide ($H_2O_2$). Then the $H_2O_2$ is reduced to water ($H_2O$) and ($O^-$) at the surface of the working electrode. The $O^-$ draws a positive charge from the sensor electrical components, thus repelling an electron and causing an electrical current flow. This results in the analog current signal being proportional to the concentration of glucose in the ISF that is in contact with the sensor electrodes (see e.g. U.S. Pat. No. 7,354,420).

In some examples, more than one sensor is used to measure blood glucose. For example, redundant sensors can be used and the subject can be notified when a sensor fails by the telemetered characteristic monitor transmitter electronics. An indicator also can inform the subject of which sensors are still functioning and/or the number of sensors still functioning. In other examples, sensor signals are combined through averaging or other means. Further, different types of sensors can be used. For example, an internal glucose sensor and an external glucose sensor can be used to measure blood glucose at the same time.

Glucose sensors that can be used in a closed loop system that delivers the super fast-acting insulin compositions provided herein are well known and can be readily identified and, optionally, further modified, by one of skill in the art. Exemplary internal glucose sensors include, but are not limited to, those described in U.S. Pat. Nos. 5,497,772, 5,660,163, 5,791,344, 5,569,186, 6,895,265. Exemplary of a glucose sensor that uses florescence is that described in U.S. Pat. No. 6,011,984. Glucose sensor systems also can use other sensing technologies, including light beams, conductivity, jet sampling, micro dialysis, micro-poration, ultra sonic sampling, reverse iontophoresis, or other method (e.g. U.S. patent Nos. 5,433,197 and 5,945,676, and International Pat. Pub. WO199929230. In some examples, only the working electrode is located in the subcutaneous tissue and in contact with the ISF, and the counter and reference electrodes are located external to the body and in contact with the skin. The counter electrode and the reference electrode can be located on the surface of a monitor housing and can be held to the skin as part of a telemetered characteristic monitor. In further examples, the counter electrode and the reference electrode are held to the skin using other devices, such as running a wire to the electrodes and taping the electrodes to the skin, incorporating the electrodes on the underside of a watch touching the skin.. Still further, more than one working electrode can be placed into the subcutaneous tissue for redundancy. Interstitial fluid also can be harvested from the body of a subject and flowed over an external sensor that is not implanted in the body.

The controller receives input from the glucose sensor. The controller is designed to model a pancreatic beta cell (β-cell) and provide commands to the insulin delivery device to infuse the required amount of insulin for glycemic control. The controller utilizes software with algorithms to calculate the required amount of insulin based upon the glucose levels detected by the glucose sensor. Exemplary algorithms include those that model the β-cells closely, since algorithms that are designed to minimize glucose excursions in the body, without regard for how much insulin is delivered, can cause excessive weight gain, hypertension, and atherosclerosis. Typically, the system is intended to emulate the in vivo insulin secretion pattern and to adjust this pattern consistent with the in vivo β-cell adaptation experienced by normal healthy individuals. Control algorithms useful for closed loop systems include those utilized by a proportional-integral-derivative (PID)

controller. Proportional derivative controllers and model predictive control (MPC) algorithms also can be used in some systems (Hovorka et al. (2006) Diabetic Med. 23:1-12). Exemplary algorithms include, but are not limited to, those described Hovorka et al. (Diabetic Med. (2006) 23:1-12), Shimoda et al., (Front Med Biol Eng (1997) 8:197-211), Shichiri et al. (Artif. Organs (1998) 22:32-42), Steil et al. (Diabetes Technol Ther (2003) δ: 953-964), Kaletz et al., (Acta Diabetol. (1999) 36:215) and U.S. Pat. Nos. 5,279,543, 5,569,186, 6,558,351, 6,558,345, 6,589,229, 6,740,042, 6,669,663, 6,740,072, 7,267,665, 7,354,420 and U.S. Pat. Pub. No. 20070243567.

In one example, a PID controller is utilized in the closed loop system. A PID controller continuously adjusts the insulin infusion by assessing glucose excursions from three viewpoints: the departure from the target glucose (the proportional component), the area under the curve between ambient and target glucose (the integral component), and the change in ambient glucose (the derivative component). Generally, the in vivo β-cell response to changes in glucose is characterized by "first" and "second" phase insulin responses. The biphasic insulin response of a β-cell can be modeled using components of a proportional, plus integral, plus derivative (PID) controller (see e.g. U.S. Pat. No. 7,354,420).

The controller generates commands for the desired insulin delivery. Insulin delivery systems, such as insulin pumps, are known in the art and can be used in the closed loop systems. Exemplary insulin delivery devices (such as those described above) include, but are not limited to, those described in U.S. Pat. Nos. 4,562,751, 467,840, 4,685,903, 4,373,527, 4,573,994, 6,554,798, 6,641,533, 6,744,350, 6,852,104, 6,872,200, 6,936,029, 6,979,326, 6,999,854, 7,025,713 and 7,109,878. The insulin delivery devices typically contain one or more reservoirs, which generally are disposable, containing an insulin preparation, such as a super fast-acting insulin composition described herein. The reservoirs can contain more than one insulin, such as, for example, a basal-acting insulin and a fast-acting insulin, either co-formulated and contained in a single reservoir or contained separately in two or more reservoirs. For use with a super fast-acting insulin composition, the insulin delivery device can contain one reservoir containing a co-formulated fast-acting insulin and hyaluronan degrading enzyme composition, or can contain two or more reservoirs, such that the fast-acting insulin and hyaluronan degrading enzyme compositions are contained separately in separate reservoirs. In such instances, the insulin delivery device can deliver each composition simultaneously or subsequent to each other. In some examples, the compositions are delivered using an infusion tube and a cannula or needle. In other examples, the infusion device is attached directly to the skin and the compositions flow from the infusion device, through a cannula or needle directly into the body without the use of a tube. In further examples, the infusion device is internal to the body and an infusion tube optionally can be used to deliver the compositions. Closed loop systems also can contain additional components, including, but not limited to, filters, calibrators and transmitters.

G. Methods of Assessing Activity, Pharmacokinetics and Pharmacodynamics

Assays can be used to assess the in vitro and in vivo activities of insulin alone or in combination with a hyaluronan degrading enzyme. Included among such assays are those that assess the pharmacokinetic and pharmaocodynamic properties of subcutaneously or intraperitonally-administered insulin, including bioavailability, and tolerability. The biological activity of both insulin and a hyaluronan degrading enzyme also can be assessed using assays well known in the art. Such assays can be used, for example, to determine appropriate dosages of an insulin, such as a fast-acting insulin, and a hyaluronan degrading enzyme, and the frequency of dosing, for treatment.

1. Pharmacokinetics, Pharmacodynamics and Tolerability

Pharmacokinetic (PK), pharmacodynamic (PD) and tolerability studies, such as those described in Example 1, below, can be performed using animal models, including pig models such as those described in Examples 11 and 12, or can be performed during clinical studies with patients. Animal models include, but are not limited to, mice, rats, rabbits, dogs, guinea pigs and non-human primate models, such as cynomolgus monkeys or rhesus macaques. In some instances, pharmacokinetic and tolerability studies are performed using healthy animals or human subjects. In other examples, the studies are performed using animal models of diabetes, such as those described below, or in diabetic human subjects. Exemplary procedures useful for performing these studies include glucose clamp techniques (Brehm et al (2007) in Clin Diabetes Res: Methods and Techniques. Ed Michael Rosen, pp 43-76, Example 1). In the hyperinsulinemic euglycemic clamp procedure, exogenous insulin is infused to create hyperinsulinemic plasma insulin concentrations, while the plasma glucose concentration is kept constant at the euglycemic level by means of a variable exogenous glucose infusion. The glucose infusion rate (GIR) required to maintain constant glucose levels during the period of hyperinsulinemia provides a measure of the effect of the infused insulin on glucose metabolism. The GIR is a reflection of the amount of glucose being used by the body (i.e. more exogenous glucose needs to be infused to maintain normal blood glucose levels i.e. between 90-110 mg/dL, when the body is using more glucose), and, therefore, the activity of the administered insulin (i.e. increased insulin activity results in reduced endogenous glucose output and increased blood glucose utilization, resulting in an overall decline of blood glucose). Thus, such a procedure, in addition to being used to assess insulin secretion and insulin resistance in a subject, also can be used to safely assess the pharmacokinetic and pharmacodynamic properties of an insulin, such as an insulin co-administered with a hyaluronan degrading enzyme.

The pharmacokinetics of subcutaneously or intraperitoneally administered insulin can be assessed by measuring the time-concentration profile of the insulin and calculating such parameters as the maximum (peak) serum insulin concentration ($C_{max}$), the peak time (i.e. when maximum serum insulin concentration occurs; $t_{max}$), and area under the curve (i.e. the area under the curve generated by plotting time versus blood insulin concentration; AUC), for any given time interval following administration. The absolute bioavailability of subcutaneously administered insulin is determined by comparing the area under the curve of insulin following subcutaneous delivery ($AUC_{sc}$) with the AUC of insulin following intravenous delivery ($AUC_{iv}$). Absolute bioavailability (F), can be calculated using the formula: $F=[([AUC]_{sc} \times dose_{sc})/([AUC]_{iv} \times dose_{iv})] \times 100$. The relative bioavailability ($F_{rel}$) of two treatments via the same route of administration, such as, for example, an insulin with or without co-administration with a hyaluronan degrading enzyme, also can be calculated, such as in Example 1. For example, the relative bioavailability ($F_{rel}$) of subcutaneously administered Humalog® insulin lispro co-administered with rHuPH20 and subcutaneously administered Humalog® insulin lispro alone can be calculated {[AUC (Humalog® insulin lispro /rHuPH20)]/[AUC(Humalog® insulin lispro alone]}×100, where each dose of Humalog® insulin lispro is the same, and the AUC is calculated over the same time interval. The concentration of insulin in the plasma following subcutaneous administration can be measured using any method known in the art suitable for assessing concentrations of insulin in samples of blood. Exemplary methods include, but are not limited to, ELISA and RIA.

The pharmacodynamic properties of subcutaneously or intraperitoneally administered insulin, can be assessed by measuring such parameters as the glucose infusion rate (GIR) (mg/kg/min), time to maximal effect ($tGIR_{max}$) (minutes); the time to late half-maximal effect ($tGIR_{late\ 50\%}$) (minutes); the time to early half-maximal effect ($tGIR_{early\ 50\%}$) (minutes); the maximal metabolic effect ($GIR_{max}$) (mg/kg/minute); $AUC\text{-}GIR_{0\text{-}60\ min}$ (g/kg); $AUC\text{-}GIR_{0\text{-}120\ min}$ (g/kg); $AUC\text{-}GIR_{0\text{-}180\ min}$ (g/kg); $AUC\text{-}GIR_{0\text{-}240\ min}$ (g/kg); $AUC\text{-}GIR_{0\text{-}300\ min}$ (g/kg); and the $AUC\text{-}GIR_{0\text{-}360\ min}$ (g/kg).

A range of doses and different dosing frequency of dosing can be administered in the pharmacokinetic studies to assess the effect of increasing or decreasing concentrations of insulin and/or a hyaluronan degrading enzyme in the dose. Pharmacokinetic and pharmacodynamic properties of subcutaneously or intraperitonally administered insulin, such as bioavailability, also can be assessed with or without co-administration of a hyaluronan degrading enzyme. For example, animals or human subjects can be administered insulin subcutaneously alone or in combination with a hyaluronan degrading enzyme during a hyperinsulinemic euglycemic clamp procedure. Blood samples can then be taken at various time points and the amount of insulin in the serum determined, such as by radioimmunoassay (RIA) or enzyme-linked immunosorbent assay (ELISA). The glucose infusion rate throughout the procedure also can be calculated. The pharmacokinetic and pharmacodynamic properties of subcutaneously administered insulin administered with or without a hyaluronan degrading enzyme can then be determined to assess the effect of co-administration with a hyaluronan degrading on such properties of any insulin.

Studies to assess safety and tolerability also are known in the art and can be used herein. Following subcutaneous administration of insulin, with or without co-administration of a hyaluronan degrading enzyme, the development of any adverse reactions can be monitored. Adverse reactions can include, but are not limited to, injection site reactions, such as edema or swelling, headache, fever, fatigue, chills, flushing, dizziness, urticaria, wheezing or chest tightness, nausea, vomiting, rigors, back pain, chest pain, muscle cramps, seizures or convulsions, changes in blood pressure and anaphylactic or severe hypersensitivity responses. Typically, a range of doses and different dosing frequencies are administered in the safety and tolerability studies to assess the effect of increasing or decreasing concentrations of insulin and/or a hyaluronan degrading enzyme in the dose.

2. Biological Activity a. Insulin

The ability of an insulin, such as an insulin analog, to act as a therapeutic agent can be assessed in vitro or in vivo. For example, in vitro assays well known in the art can be performed to assess the ability an insulin to bind to insulin receptor. In one example, a competitive binding assay is performed in which human placental cell membranes are prepared as a source of insulin receptors and incubated with radiolabeled human insulin with or without the unlabeled insulin analog. The amount of bound radiolabeled insulin is then detected to determine the ability of the insulin analog to compete for binding and the relative affinity of the insulin analog for the placental insulin receptor is calculated (see e.g. Weiss et al., (2001) J. Biol. Chem. 276:40018-40024). Other sources of insulin receptors, including other cells that naturally or recombinantly express the insulin receptor, also can be used in such competitive binding assays (Duttaroy et al., (2005) Diabetes 54:251-258).

The ability of insulin to stimulate glucose uptake or effect any other of its typical metabolic outcomes can be assessed in vitro. To measure insulin-stimulated glucose uptake, adipocytes are incubated with labeled glucose, such as 2-deoxy-D-[2,6$^3$-H]glucose or D-[U-$^{14}$C]glucose with or without insulin. The incorporated radioactivity is then measured to determine the amount of glucose uptake in the presence or absence of insulin (Louveau et al., (2004) J. Endocrin. 181:271-280, Duttaroy et al., (2005) Diabetes 54:251-258). When assessing the activity of an insulin analog, the activity of human insulin also can be assessed and used for comparison. In vitro assays to assess glucose production in H4IIE cells in the presence of insulin also can be performed (Wang et al., (2000) J. Bioche, 275:14717-14721, Duttaroy et al., (2005) Diabetes 54:251-258).

In vivo studies using diabetic or healthy animal models or human subjects also can be performed to assess the therapeutic activity of insulin. Insulin can be administered to animal models of diabetes to assess the effects on blood glucose levels, circulating insulin levels, and hemoglobin A1c (HbA1c), for example. Hemoglobin A1c forms when glucose attaches to hemoglobin, which occurs when blood glucose levels are elevated. HbA1c levels in a blood sample can be assessed by, for example, HPLC, ELISA, RIA or other immunoassay, Normal HbA1c values for healthy subjects are approximately 4.0-6.2 percent. The American Diabetes Association recommends that it should be below 7% (or below 6% in certain persons) for patients with diabetes to help prevent the complications from diabetes. Insulin levels can be measured by, for example, ELISA or RIA. Glucose levels are typically measured using a glucose sensor or analyzer.

Animal models for type I diabetes include the nonobese diabetic (NOD) mouse and the BioBreeding (BB) rat (Atkinson et al., (1999) Nature Med. 5:601-604). Animal models for type 2 diabetes include, but are not limited to, ob/ob mice and db/db mice, which have mutations in the leptin gene or leptin receptor, respectively, KK mice, Nagoya-Shibata-Yasuda (NSY) mice, Zucker diabetic fatty (ZDF) rats and Gato-Katazaki (GK) rats (Cefalu (2006) ILAR Journal 47:186-198). In other examples, healthy animals are used to test the activity of an insulin, with or without a hyaluronan degrading enzyme.

b. Hyaluronan Degrading Enzymes

The activity of a hyaluronan degrading enzyme can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, MD). A Hyaluronidase Reference Standard (USP) or National Formulary (NF) Standard Hyaluronidase solution can be used in an assay to ascertain the activity, in units, of any hyaluronidase. In one example, activity is measured using a microturbidity assay. This is based on the formation of an insoluble precipitate when hyaluronic acid binds with serum albumin. The activity is measured by incubating hyaluronidase with sodium hyaluronate (hyaluronic acid) for a set period of time (e.g. 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity. In another example, hyaluronidase activity is measured using a microtiter assay in which residual biotinylated hyaluronic acid is measured following incubation with hyaluronidase (see e.g. Frost and Stern (1997) Anal. Biochem. 251:263-269, U.S. Patent Publication No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidase activity also are known in the art and can be used in the methods herein (see e.g. Delpech et al., (1995) Anal. Biochem. 229:35-41; Takahashi et al., (2003) Anal. Biochem. 322:257-263).

The ability of a hyaluronan degrading enzyme to act as a spreading or diffusing agent also can be assessed. For example, trypan blue dye can be injected subcutaneously with or without a hyaluronan degrading enzyme into the lateral skin on each side of nude mice. The dye area is then measured, such as with a microcaliper, to determine the ability of the hyaluronan degrading enzyme to act as a spreading agent (U.S. Patent No. 20060104968). The effect of co-administration of hyaluronidase with another agent, such as an insulin, on the pharmacokinetic and pharmacodynamic properties of that agent also can be assessed in vivo using animal model and/or human subjects, such as in the setting of a clinical trial, as discussed above and demonstrated in Example 1, below. The functional activity of a hyaluronan degrading enzyme that is not a hyaluronidase can be compared to a hyaluronidase using any of these assays. This can be done to determine what a functionally equivalent amount of a hyaluronan degrading enzyme is. For example, the ability of a hyaluronan degrading enzyme to act as a spreading or diffusing agent can be assessed by injecting it into the lateral skin of mice with trypan blue, and the amount required to achieve the same amount of diffusion as, for example, 100 units of a Hyaluronidase Reference Standard, can be determined. The amount of hyaluronan degrading enzyme required is, therefore, functionally equivalent to 100 hyaluronidase units.

H. Therapeutic Uses

The methods described herein can be used for treatment of any condition for which a fast-acting insulin is employed. Insulin can be administered subcutaneously, in combination with a hyaluronan degrading enzyme, to treat any condition that is amendable to treatment with insulin. Typically, a hyaluronan degrading enzyme is co-administered with a fast-acting insulin. This section provides exemplary therapeutic uses of fast-acting insulin. The therapeutic uses described below are exemplary and do not limit the applications of the methods described herein. Therapeutic uses include, but are not limited to, treatment for type 1 diabetes mellitus, type 2 diabetes mellitus, gestational diabetes, and for glycemic control in critically ill patients. For example, fast-acting insulin can be administered in combination with a hyaluronan degrading enzyme subcutaneously in discrete doses, such as via a syringe or insulin pen, prior to a meal as prandial insulin therapy in subjects with diabetes to achieve glycemic control. Fast-acting insulin also can be administered subcutaneously or intraperitonally in combination with a hyaluronan degrading enzyme using an insulin pump or in the context of a closed loop system to continuously control blood glucose levels throughout the day and night and/or to control post-prandial glycemic excursions. It is within the skill of a treating physician to identify such diseases or conditions.

As discussed above, particular dosages and treatment protocols are typically individualized for each subject. If necessary, a particular dosage and duration and treatment protocol can be empirically determined or extrapolated. For example, exemplary doses of fast-acting insulin without a hyaluronan degrading enzyme can be used as a starting point to determine appropriate dosages for the methods provided herein. Dosage levels can be determined based on a variety of factors, such as body weight of the individual, general health, age, the activity of the specific compound employed, sex, diet, metabolic activity, blood glucose concentrations, time of administration, rate of excretion, drug combination, the severity and course of the disease, and the patient's disposition to the disease and the judgment of the treating physician. In particular, blood glucose levels, such as measured by a blood glucose sensor, can be measured and used to determine the amount of insulin and a hyaluronan degrading enzyme to be administered to achieve glycemic control. Algorithms are known in the art that can be used to determine a dose based on the rate of absorption and level of absorption of the super fast-acting compositions provided herein, and also based upon blood glucose levels. Dosages of insulin for post-prandial glycemic control also can be calculated or adjusted, for example, by determining the carbohydrate content of a meal (Bergenstal et al., (2008) Diabetes Care, Lowe et al., (2008) Diabetes Res. Clin. Pract., Chiesa et al., (2005) Acta Biomed. 76:44-48).

1. Diabetes Mellitus

Diabetes mellitus (or diabetes) is characterized by an impaired glucose metabolism. Blood glucose is derived from carbohydrates absorbed in the gut and produced in the liver. Increasing blood glucose levels stimulate insulin release. The postprandial glucose influx can be 20 to 30 times higher than the hepatic production of glucose observed between meals. Early phase insulin release, lasting 10 minutes or thereabouts, suppresses hepatic glucose production and precedes a longer (late) phase of release, which lasts two hours or more and covers mealtime carbohydrate influx. Between meals, a low continuous insulin level, basal insulin, covers ongoing metabolic requirements, in particular to regulate hepatic glucose output as well as glucose utilization by adipose tissue, muscle tissue and other target sites. Patients with diabetes present with elevated blood glucose levels (hyperglycemia). Diabetes can be classified into two major groups: type 1 diabetes and type 2 diabetes. Type 1 diabetes, or insulin dependent diabetes mellitus (IDDM), is characterized by a loss of the insulin-producing β-cell of the islets of Langerhans in the pancreas, leading to a deficiency of insulin. The primary cause of the β-cell deficiency is T-cell mediated autoimmunity. Type 2 diabetes, or non-insulin dependent diabetes mellitus (NIDDM), occurs in patients with an impaired β-cell function. These patients have insulin resistance or reduced insulin sensitivity, combined with reduced insulin secretion. Type 2 diabetes may eventually develop into type 1 diabetes. Also included in diabetes is gestational diabetes. Patients with diabetes can be administered insulin to both maintain basal insulin levels and to prevent glycemic excursions, such as following a meal.

a. Type 1 diabetes

Type 1 diabetes is a T-cell dependent autoimmune disease characterized by infiltration of the islets of Langerhans, the endocrine unit of the pancreas, and destruction of β-cells, leading to a deficiency in insulin production and hyperglycemeia. Type 1 diabetes is most commonly diagnosed in children and young adults but can be diagnosed at any age. Patients with type 1 diabetes can present with, in addition to low insulin levels and high blood glucose levels, polyuria, polydispia, polyphagia, blurred vision and fatigue. Patients can be diagnosed by presenting with fasting plasma glucose levels at or above 126 mg/dL (7.0 mmol/l), plasma glucose levels at or above 200 mg/dL (11.1 mmol/l) two hours after a 75 g oral glucose load, such as in a glucose tolerance test, and/or random plasma glucose levels at or above 200 mg/dL (11.1 mmol/l).

The primary treatment for patients with type 1 diabetes is administration of insulin as replacement therapy, which is typically performed in conjunction with blood glucose monitoring. Without sufficient replacement insulin, diabetic ketoacidosis can develop, which can result in coma or death. Patients can be administered subcutaneous injections of fast-acting insulin using, for example, a syringe or insulin pen, or an insulin pump to maintain appropriate blood glucose levels throughout the day and also to control post-prandial glucose levels. In some instances, an insulin pump, including in the context of a closed loop system, can be used to deliver insulin intraperitoneally. Thus, patients with type 1 diabetes can be administered the super fast-acting insulin composition described herein subcutaneously or intraperitoneally via syringe, insulin pen, or insulin pump, or any other means useful for delivering insulin, using the methods described herein to more rapidly control blood glucose and insulin levels.

b. Type 2 Diabetes

Type 2 diabetes is associated with insulin resistance and, in some populations, also by insulinopenia (loss of β-cell function). In type 2 diabetes, phase 1 release of insulin is absent, and phase 2 release is delayed and inadequate. The sharp spike of insulin release-occurring in healthy subjects during and following a meal is delayed, prolonged, and insufficient in amount in patients with type 2 diabetes, resulting in hyperglycemia. Patients with type 2 diabetes can be administered insulin to control blood glucose levels (Mayfield et al (2004) Am Fam Physican 70:489-500). This can be done in combination with other treatments and treatment regimes, including diet, exercise and other anti-diabetic therapies (e.g. sulphonylureas, biguanides, meglitinides, thiazolidinediones and alpha-glucosidase inhibitors). Thus, patients with type 2 diabetes can be administered the super fast-acting insulin compositions described herein subcutaneously or intraperitoneally via syringe, insulin pen, or insulin pump, or any other means useful for delivering insulin, using the methods described herein to more rapidly control blood glucose and insulin levels. As discussed elsewhere herein, administration of super fast-acting insulin compositions to Type 2 diabetic patients can, in addition to achieving better glycemic control compared to the corresponding fast-acting insulin, reduce the risk of weight gain and obesity that is often associated with insulin therapy in Type 2 diabetic patients.

c. Gestational diabetes

Pregnant women who have never had diabetes before but who have high blood glucose levels during pregnancy are diagnosed with gestational diabetes. This type of diabetes affects approximately 1-14% of all pregnant women, depending upon the population studied (Carr et al., (1998) *Clinical Diabetes* 16). While the underlying cause remains unknown, it appears likely that hormones produced during pregnancy reduce the pregnant woman's sensitivity to insulin. The mechanism of insulin resistance is likely a postreceptor defect, since normal insulin binding by insulin-sensitive cells has been demonstrated. The pancreas releases 1.5-2.5 times more insulin in order to respond to the resultant increase in insulin resistance. Patients with normal pancreatic function are able to meet these demands. Patients with borderline pancreatic function have difficulty increasing insulin secretion and consequently produce inadequate levels of insulin. Gestational diabetes thus results when there is delayed or insufficient insulin secretion in the presence of increasing peripheral insulin resistance.

Patients with gestational diabetes can be administered insulin to control blood glucose level. Thus, patients with gestational diabetes can be administered the super fast-acting insulin compositions described herein subcutaneously via syringe, insulin pen, insulin pump or artificial pancreas, or any other means, using the methods described herein to more rapidly control blood glucose and insulin levels.

2. Insulin Therapy for Critically Ill Patients

Hyperglycemia and insulin resistance occurs frequently in medically and/or surgically critically ill patients and has been associated with increased morbidity and mortality in both diabetic and non-diabetic patients and in patients with traumatic injury, stroke, anoxic brain injury, acute myocardial infarction, post-cardiac surgery, and other causes of critical illness (McCowen et al. (2001) Crit. Clin. Care 17:107-124). Critically ill patients with hyperglycemia have been treated with insulin to control blood glucose levels. Such treatment can reduce morbidity and mortality amongst this group (Van den Berghe et al. (2006) N. Eng. J. Med. 354:449-461). Insulin is typically administered intravenously to the patient, such as by injection with a syringe by a medical practitioner or by infusion using an insulin pump. In some examples, algorithms and software are used to calculate the dose. Thus, critically ill patients with hyperglycemia can be administered a super fast-acting insulin composition described herein to control blood glucose levels, thereby alleviating the hyperglycemia and reducing morbidity and mortality.

I. Combination Therapies

Any of the super fast-acting insulin compositions described herein can be administered in combination with, prior to, intermittently with, or subsequent to, other therapeutic agents or procedures including, but not limited to, other biologics and small molecule compounds. For any disease or condition, including all those exemplified above, for which a fast-acting insulin is indicated or has been used and for which other agents and treatments are available, the super fast-acting insulin compositions can be used in combination therewith. Depending on the disease or condition to be treated, exemplary combinations include, but are not limited to, combination with anti-diabetic drugs, including, but not limited to, sulfonylureas, biguanides, meglitinides, thiazolidinediones, alpha-glucosidase inhibitors, peptide analogs, including glucagon-like peptide (GLP) analogs and, gastric inhibitory peptide (GIP) analogs and DPP-4 inhibitors. In another example, the super fast-acting insulin compositions described herein can be administered in combination with, prior to, intermittently with, or subsequent to, with one or more other insulins, including fast-acting insulin, and basal-acting insulins.

J. Articles of Manufacture and Kits

Pharmaceutical compounds of the super fast-acting insulin compositions, insulin and/or hyaluronan degrading enzyme compositions provided herein can be packaged as articles of manufacture containing packaging material, a pharmaceutical composition which is effective for controlling blood glucose levels, such as in diabetic or critically subjects, and a label that indicates that the super fast-acting insulin compositions, insulin and/or hyaluronan degrading enzyme compositions are to be used for controlling blood glucose levels.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,352, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any hemostatic disease or disorder.

Super fast-acting insulin compositions, insulin and/or hyaluronan degrading enzyme compositions also can be provided as kits. Kits can include a pharmaceutical composition described herein and an item for administration. The kits also can include additional pharmaceutical compositions. In one example, the kits can include one or more of the super fast-acting insulin compositions, insulin and/or hyaluronan degrading enzyme compositions provided herein and one or more other insulin compositions, such as for example, slow acting or intermediate-acting insulins, including crystalline insulins, or any combination thereof. The super fast-acting insulin compositions, insulin and/or hyaluronan degrading enzyme compositions and/or other pharmaceutical compositions can be supplied with a device for administration, such as a syringe, an insulin pen, a pump, or a reservoir that is inserted into an insulin pen, a pump or other delivery device. The kit can, optionally, include instructions for application including dosages, dosing regimens and instructions for modes of administration. Kits also can include a pharmaceutical composition described herein and an item for diagnosis. For example, such kits can include a glucose monitor or sensor.

The kits for example also can contain a variety of fast-acting insulin compositions, or other insulin composition, including one or more basal-acting insulins, provided in separate containers and in varying dosages, whereby the user is afforded the opportunity to select a given insulin dosage, such as a prandial dosage, to the specific circumstances involving an actual or anticipated occurrence of hyperglycemia.

K. EXAMPLES

The following examples are included for illustrative purposes only and are not intended to limit the scope of the invention.

Example 1

Co-Administration of Recombinant Human PH20 (rHuPH20) and Fast-Acting Insulin Facilitates Improved Pharmacokinetics and Pharmacodynamics Insulin, including insulin analogs, is administered to subjects with diabetes mellitus for the control of hyperglycemia. In an effort to more effectively replicate normal physiologic prandial insulin release observed in healthy subjects, clinical studies were performed to determine if co-administration of recombinant Human PH20 (rHuPH20) could increase the early absorption rate and the amount of absorption of the administered fast-acting insulin. Increased absorption could result in the fast-acting insulin being even faster-acting and, therefore, more closely mimicking the endogenous insulin concentration-time profile observed in healthy subjects. This could provide clinical benefit with respect to better glycemic control and reduced weight gain in subjects with diabetes mellitus. The clinical studies were designed to assess safety, tolerability, pharmacokinetics (PK) and pharmacodynamics (PD) of Humulin® R insulin and Humalog® 0 insulin lispro (both being fast-acting insulins as described herein) administered subcutaneously either alone or in combination with rHuPH20.

Example 1a

Pharmacokinetics and Pharmacodynamics of Humalog® Insulin Lispro or Humulin® R Insulin with and without Co-Administration of rHuPH20 in Healthy (Non-Diabetic) Subjects A randomized, double-blind, crossover, two-stage, sequential 2-arm study to assess subcutaneous administration 20 units (U) Humalog® insulin lispro or Humulin® R insulin with and without co-administration of rHuPH20 was performed. Twenty-five healthy adult male subjects were enrolled in the study. In stage 1, 12 subjects received a subcutaneous injection of Humalog® insulin lispro and rHuPH20 and a separate subcutaneous injection of Humalog® insulin lispro alone. Injections were usually 7 days apart, with half of the subjects receiving Humalog® insulin lispro and rHuPH20 first, followed by Humalog® insulin lispro alone, and half of the subjects receiving Humalog® insulin lispro alone first, then Humalog® insulin lispro and rHuPH20. In stage 2, 13 subjects received a subcutaneous injection of Humulin® R insulin and rHuPH20 and a separate subcutaneous injection of Humulin® R insulin alone. Injections were usually 7 days apart, with approximately half of the subjects receiving Humulin® R and rHuPH20 first followed by Humulin® R insulin alone, and half of the subjects receiving Humulin® R insulin alone first then Humulin® R insulin and rHuPH20.

Approximately 14 hours prior to each injection, each of the subjects received a dinner based on an American Diabetes Association 2000-calorie meal plan with 60 g carbohydrates. A snack of 30 g carbohydrate also was provided. Approximately 6 hours after dinner, the subjects started fasting (except water) for at least 8 hours before being started on a Hyperinsulinemic-Euglycemic Clamp procedure for an 8 hour period. Pre-treatment blood samples were collected and vital signs and weight were measured before the subjects were injected with Humalog® insulin lispro, Humalog® insulin lispro/rHuPH20, Humulin® R insulin or Humulin® R insulin/rHuPH20 2 hours after the Hyperinsulinemic-Euglycemic Clamp procedure was initiated. Blood samples were collected at prescribed intervals, as described below, and glucose and insulin levels were quantified for a period of 6 hours.

A. Dosing

As described above, 12 subjects were administered 20 U Humalog® insulin lispro and 300 U rHuPH20 in 220 µL, and 20 U Humalog® insulin lispro in 200 µL subcutaneously in the lower left abdominal quadrant in the first stage of the study. The Humalog® insulin lispro/rHuPH20 dose was prepared by first thawing rHuPH20 (1 mg/mL, equivalent to about 120,000 U/mL in 10 mM HEPES/130 mM NaCl at pH ~7.0) at room temperature for an hour and asceptically aspirating 0.153 cc (equivalent to 18,360 U) rHuPH20 into a 0.3 cc capacity insulin syringe. The 0.153 cc rHuPH20 was then transferred slowly into a vial containing 1.17 mL of 150 U/mL HYLENEX (rHuPH20). From this vial, 1.1 mL was aspirated and transferred into a vial containing about 10.2 mL of 100 U/mL Humalog® insulin lispro aspirated from the vial. Two hundred and twenty microliters of the Humalog® insulin lispro/rHuPH20 mixture was then aspirated using a 0.3 cc capacity insulin syringe and used within 4 hours for subcutaneous administration to a single subject.

Thus, the Humalog® insulin lispro/rHuPH20 mixture that was delivered was 220 µL and contained 300 U rHuPH20 (2.5 µg), 20 U Humalog® insulin lispro, 0.02 mg Human Serum Albumin (From the Hylenex formulation (functions to stabilize rHuPH20 against adsorptive losses and also can have stabilizing properties relative to insulin and/or act as an oxidation scavenger); 3 mg glycerin (from the Humalog® insulin lispro formulation (present as a pH buffer, stabilizer of insulin and/or tonicity modifier); 0.6 mg m-cresol (from the Humalog® insulin lispro formulation (antimicrobial growth preservative present at elevated concentrations to stabilize the insulin hexamer conformation); 0.004 mg zinc (from the Humalog® insulin lispro formulation used to stabilize the insulin hexamer conformation); 0.18 mg NaCl (from the Hylenex formulation and rHuPH20 API, as a tonicity modifier); 0.4 phosphate, sodium dibasic (from the Hylenex formulation, as a pH buffer); 0.017 mg EDTA, disodium (from the Hylenex formulation as a metal chelator with the potential to bind $Zn^{2+}$ and $Ca^{2+}$ ions); 0.006 mg calcium chloride (from the Hylenex formulation, forms a complex with EDTA and can improve subcutaneous injection comfort); 0.006 mg HEPES (from rHuPH20 API formulation, as pH buffer); water (as the solvent) and NaOH and/or HCl for pH adjustment.

In Stage 2, as described above, 13 subjects were administered both 20 U Humulin R insulin and 240 U rHuPH20 in 200 µL and 20 U Humulin® R insulin in 200 µL subcutaneously into the lower left abdominal quadrant. The Humulin® R insulin/rHuPH20 dose was prepared by first aspirating 0.3 cc (150 U) from a vial of Humulin® R insulin using a 0.3 cc capacity insulin syringe and transferring it into a vial containing 1.2 mL of 1500 U/mL rHuPH20 (formulated as a 10× composition of HYLENEX). The mixture was gently mixed and 0.3 cc of air was removed from the vial before 200 µL (containing 20 U Humulin® R insulin and 240 U rHuPH20) was aspirated using a 0.3 cc capacity insulin syringe. This was used within 4 hours for subcutaneous administration to a single subject. The 20 U Humulin® R insulin in 200 µL dose was prepared by subcutaneously using a single syringe.

Thus, the Humulin® R insulin/rHuPH20 mixture that was delivered was 200 µL and contained 240 USP U rHuPH20 (2 µg), 20 U Humulin® R insulin, 0.16 mg Human Serum Albumin (from the 10× HYLENEX formulation, functioning to stabilize rHuPH20 against adsorptive losses and also potentially to provide stabilizing properties relative to insulin and/or act as an oxidation scavenger); 3 mg glycerin (from the Humulin® R formulation, acting as a pH buffer, stabilizer of insulin and/or tonicity modifier); 0.4 mg m-cresol (from the Humulin® R formulation, acting as an antimicrobial growth preservative present at elevated concentrations to stabilize the insulin hexamer conformation); 0.34 mg zinc (from the Humulin® R formulation, acting to stabilize the insulin hexamer conformation); 1.36 mg NaCl (from the 10× Hylenex formulation and rHuPH20 API, acting as tonicity modifier); 0.224 phosphate, sodium dibasic (from the 10× Hylenex formulation, for pH buffer); 0.161 mg EDTA, disodium (from the 10× Hylenex formulation, as metal chelator with the potential to bind $Zn^{2+}$ and $Ca^{2+}$ ions); 0.048 mg calcium chloride (from the 10× Hylenex formulation, which forms a complex with EDTA and can improve subcutaneous injection comfort); water (as the solvent) and NaOH and/or HCl for pH adjustment.

B. hyperinsulinemic-Euglycemic Clamp Procedure

The effect of co-administration of rHuPH20 on pharmacokinetics and pharmacodynamics of subcutaneously administered Humalog® insulin lispro or Humulin® R insulin was assessed by taking blood samples to measure insulin (i.e. Humalog® insulin lispro or Humulin® R insulin) and glucose levels. A Hyperinsulinemic-Euglycemic Clamp Procedure was used to maintain plasma glucose levels between 90-110 mg/dL so that the insulin preparations could be administered without causing hypoglycemia.

The procedure consisted of initially obtaining the subject's weight and height and measuring the vital signs after resting in a sitting position for 5 minutes. Both arms were placed in heating pads to dilate the veins and IV catheters were then inserted. A catheter was placed into the antecubital vein of one arm for infusion of Dextrose 20% via two separate stop cocks. The other intra-arterial catheter was placed into the other arm for sampling of arterialized blood for glucose measurements. The heating pad can be removed from the glucose infusion site, but the retrograde catheter site was maintained at 65° C. An initial blood sample was obtained to measure baseline glucose 30 minutes before injection of the insulin preparations. Blood was sampled 10 minutes and 1 minute before injection of Humalog® insulin lispro, Humalog® insulin lispro/rHuPH20, Humulin® R insulin or Humulin® R insulin/rHuPH20, then every 3 minutes for the first 60 minutes, every 15 minutes from 60 minutes to 3 hours, then every hour thereafter to 6 hours. Each subjects' glucose levels were analyzed throughout the procedure using a YSI 2300 Glucose Analyzer (YSI Inc.) and the glucose infusion rate (GIR) was adjusted as necessary to maintain plasma glucose between 90-110 mg/dL. Circulating levels of insulin were analyzed using a radioimmunsorbant assay (RIA) that quantifies levels of Humalog® insulin lispro and Humulin® R insulin (Millipore BioPharma Services Division, St. Charles Mo.).

C. Effect of Co-Administration of rHuPH20 on the Pharmacokinetics of Fast-Acting Insulin Several parameters were measured to determine the effect of co-administration of rHuPH20 on the pharmacokinetics of fast-acting insulin composition Humalog® insulin lispro and Humulin® R insulin. These included the maximum measured insulin concentration during the selected dosing interval ($C_{max}$); time to $C_{max}$($t_{max}$); and area under the concentration vs. time curves (AUC), which was assessed for various time intervals.

1. Effect of Co-Administration of rHuPH20 and Humalog® Insulin on Insulin Pharmacokinetics The insulin concentration for each time interval following administration of Humalog® insulin lispro or Humalog® insulin lispro/rHuPH20 was assessed by RIA, and is set forth in Tables 5 and 6, respectively. The AUC for the different time intervals (0 minutes to x minutes; e.g. $AUC_{0-3 \ minutes}$, $AUC_{0-6 \ minutes}$, $AUC_{0-9 \ minutes}$, etc.) also is provided, as is the relative bioavailability ($F_{rel}$), which is calculated as the [$AUC_{0-x}$ (Humulin® R insulin +rHuPH20)]/[$AUC_{0-x}$ (Humulin® R insulin alone]* 100. The incremental slope, which is determined by calculating the change in geometric mean insulin levels over a time interval, also is presented, as is the average slope change, which is a smoothed average of three values of the incremental slope.

TABLE 5

Insulin concentration in the blood following Humalog®
insulin lispro administration
Immunoreactive insulin (pmol/L)

| Time (mins) (min) | Mean | Median | SD (pmol/L) | SE | GeoMean | Incremental Slope (pmol/L · min) | AUC (0-x) (pmol · min/L) | Slope Change (avg) (pmol/L · min) |
|---|---|---|---|---|---|---|---|---|
| 0 | 72.4 | 64.8 | 35.2 | 10.2 | 65.2 | | | |
| 3 | 78.7 | 67.8 | 31.8 | 9.6 | 73.2 | 2.67 | 208 | |
| 6 | 82.3 | 84.8 | 24.9 | 7.5 | 79.0 | 1.93 | 436 | 2.85 |
| 9 | 96.9 | 86.3 | 36 | 10.8 | 90.8 | 3.94 | 691 | 2.72 |
| 12 | 108.0 | 102.0 | 54.2 | 16.4 | 97.7 | 2.28 | 973 | 3.63 |
| 15 | 126.3 | 110.6 | 75.5 | 21.8 | 111.7 | 4.67 | 1287 | 5.16 |
| 18 | 160.9 | 146.1 | 116 | 33.5 | 137.2 | 8.52 | 1661 | 6.71 |
| 21 | 194.0 | 143.6 | 175.8 | 50.7 | 158.1 | 6.95 | 2104 | 8.21 |
| 24 | 233.9 | 172.0 | 228.5 | 66.0 | 185.6 | 9.17 | 2619 | 7.25 |
| 27 | 273.4 | 198.7 | 296.5 | 85.6 | 202.5 | 5.63 | 3201 | 10.1 |
| 30 | 324.9 | 242.3 | 332.9 | 96.1 | 249.0 | 15.51 | 3879 | 13.47 |
| 33 | 388.1 | 302.3 | 359.2 | 108.3 | 306.8 | 19.26 | 4712 | 15.43 |
| 36 | 417.0 | 325.4 | 343.8 | 103.6 | 341.3 | 11.51 | 5685 | 16.68 |
| 39 | 485.4 | 355.2 | 419.7 | 121.2 | 399.1 | 19.26 | 6795 | 12.2 |
| 42 | 495.2 | 354.7 | 381.9 | 110.3 | 416.6 | 5.83 | 8019 | 13.93 |
| 45 | 552.6 | 430.4 | 408.6 | 118.0 | 466.7 | 16.71 | 9344 | 9.11 |
| 48 | 553.6 | 451.4 | 387.3 | 111.8 | 481.1 | 4.78 | 10766 | 9.9 |
| 51 | 576.7 | 483.9 | 384.9 | 111.1 | 505.7 | 8.2 | 12246 | 9.83 |
| 54 | 612.8 | 504.7 | 306.3 | 88.4 | 555.2 | 16.5 | 13837 | 3.27 |
| 57 | 594.1 | 476.6 | 400.1 | 115.5 | 510.5 | −14.9 | 15436 | −0.47 |
| 60 | 551.3 | 460.1 | 258.5 | 74.6 | 501.4 | −3.03 | 16954 | |
| 75 | 596.4 | 595.1 | 214.5 | 64.7 | 561.1 | 3.98 | 24923 | |
| 90 | 573.6 | 556.5 | 193.1 | 55.8 | 541.6 | −1.3 | 33193 | |
| 105 | 584.8 | 575.7 | 131.4 | 37.9 | 571.8 | 2.01 | 41543 | |
| 120 | 566.4 | 558.9 | 92.2 | 26.6 | 559.3 | −0.83 | 50026 | |
| 135 | 530.3 | 536.4 | 76.1 | 22.0 | 525.4 | −2.26 | 58162 | |
| 150 | 533.6 | 515.7 | 92.3 | 26.6 | 526.6 | 0.08 | 66052 | |
| 165 | 491.6 | 486.8 | 96.9 | 28.0 | 482.8 | −2.92 | 73623 | |
| 180 | 463.1 | 467.1 | 93.3 | 26.9 | 454.2 | −1.9 | 80650 | |
| 240 | 348.6 | 332.3 | 97.8 | 28.2 | 335.7 | −1.98 | 104350 | |
| 300 | 261.1 | 255.5 | 81.6 | 23.6 | 248.7 | −1.45 | 121882 | |
| 360 | 190.4 | 181.9 | 49.5 | 14.3 | 184.2 | −1.08 | 134867 | |

TABLE 6

Insulin concentration in the blood following Co-Administration of
Humalog® insulin lispro and rHuPH20
Immunoreactive insulin (pmol/L)

| Time (mins) (min) | Mean | Median | SD (pmol/L) | SE | Geo-Mean | Incremental Slope (pmol/L · min) | AUC (0-x) (pmol · min/L) | Slope Change (avg) (pmol/L · min) | $F_{rel}$ (%) |
|---|---|---|---|---|---|---|---|---|---|
| 0 | 70.5 | 66.3 | 32.8 | 9.5 | 64.3 | | | | |
| 3 | 97.0 | 80.7 | 36.6 | 11.0 | 91.5 | 9.09 | 234 | | 113 |
| 6 | 144.7 | 112.2 | 92.4 | 27.8 | 126.7 | 11.73 | 561 | 9.68 | 129 |
| 9 | 183.9 | 117.3 | 156.9 | 45.3 | 151.4 | 8.22 | 978 | 11.91 | 142 |
| 12 | 254.4 | 161.1 | 252.9 | 73.0 | 198.7 | 15.78 | 1503 | 15.21 | 154 |
| 15 | 354.6 | 216.8 | 391.1 | 112.9 | 263.6 | 21.63 | 2197 | 20.13 | 171 |
| 18 | 442.8 | 293.2 | 475.4 | 137.2 | 332.5 | 22.97 | 3091 | 28.43 | 186 |
| 21 | 539.4 | 387.6 | 400.5 | 115.6 | 454.6 | 40.7 | 4271 | 33.51 | 203 |
| 24 | 651.7 | 489.4 | 426.4 | 123.1 | 565.2 | 36.86 | 5801 | 40.17 | 221 |
| 27 | 759.8 | 621.2 | 390.2 | 112.6 | 694.0 | 42.94 | 7690 | 35.71 | 240 |
| 30 | 839.7 | 705.4 | 414.5 | 119.7 | 775.9 | 27.31 | 9895 | 37.81 | 255 |
| 33 | 958.2 | 791.4 | 360.4 | 104.0 | 905.4 | 43.17 | 12417 | 33.44 | 263 |
| 36 | 1040.5 | 890.4 | 352.4 | 101.7 | 994.9 | 29.83 | 15267 | 30.15 | 269 |
| 39 | 1118.0 | 940.3 | 445.8 | 128.7 | 1047.3 | 17.47 | 18331 | 18.89 | 270 |
| 42 | 1138.7 | 991.1 | 431.6 | 124.6 | 1075.5 | 9.38 | 21515 | 20.93 | 268 |
| 45 | 1239.1 | 1181.6 | 408.6 | 118 | 1183.3 | 35.93 | 24903 | 12.26 | 267 |
| 48 | 1234.0 | 1128.7 | 497.1 | 143.5 | 1157.6 | −8.53 | 28414 | 6.46 | 264 |
| 51 | 1173.8 | 1124.0 | 326.9 | 94.4 | 1133.6 | −8.01 | 31851 | −12.3 | 260 |
| 54 | 1095.6 | 1070.5 | 236.6 | 68.3 | 1072.6 | −20.34 | 35160 | −57.21 | 254 |
| 57 | 924.7 | 961.4 | 433.0 | 125.0 | 642.7 | −143.29 | 37733 | −16.71 | 244 |
| 60 | 1055.0 | 1006.7 | 363.8 | 105.0 | 983.2 | 113.48 | 40172 | | 237 |
| 75 | 926.2 | 890.4 | 218.2 | 63.0 | 905.2 | −5.2 | 54335 | | 218 |
| 90 | 818.2 | 788.9 | 212.1 | 61.2 | 793.7 | −7.43 | 67077 | | 202 |
| 105 | 689.7 | 667.7 | 175.3 | 50.6 | 666.6 | −8.47 | 78029 | | 188 |

TABLE 6-continued

Insulin concentration in the blood following Co-Administration of
Humalog® insulin lispro and rHuPH20
Immunoreactive insulin (pmol/L)

| Time (mins) (min) | Mean | Median | SD (pmol/L) | SE | Geo-Mean | Incremental Slope (pmol/L · min) | AUC (0-x) (pmol · min/L) | Slope Change (avg) (pmol/L · min) | $F_{rel}$ (%) |
|---|---|---|---|---|---|---|---|---|---|
| 120 | 586.5 | 571.2 | 145.3 | 41.9 | 569.5 | −6.48 | 87300 | | 175 |
| 135 | 492.5 | 482.9 | 124.2 | 35.8 | 478.0 | −6.1 | 95157 | | 164 |
| 150 | 423.0 | 432.4 | 127.4 | 36.8 | 405.3 | −4.85 | 101781 | | 154 |
| 165 | 371.6 | 363.2 | 114.8 | 33.1 | 354.7 | −3.37 | 107481 | | 146 |
| 180 | 342.0 | 339.6 | 95.4 | 27.5 | 329.3 | −1.69 | 112610 | | 140 |
| 240 | 232.4 | 248.8 | 83.0 | 24.0 | 218.1 | −1.85 | 129033 | | 124 |
| 300 | 178.3 | 146.6 | 75.0 | 21.7 | 164.1 | −0.9 | 140501 | | 115 |
| 360 | 148.7 | 135.1 | 62.6 | 18.1 | 136.6 | −0.46 | 149523 | | 111 |

The $C_{max}$(pmol/L), $t_{max}$ (minutes), and $AUC_{0-360}$ (min*pmol/L) for Humalog® insulin lispro and Humalog® insulin lispro co-administered with rHuPH20 is provided in Table 7. The AUC for the different time intervals is provided in Table 8. The results indicate that subjects who received the Humalog® insulin lispro/rHuPH20 dose had greater exposure to Humalog® lispro insulin at early time intervals than those dosed with Humalog® insulin lispro alone. Table 9 provides a summary of specific PK parameters for each dosing sequence (e.g., PK for Humalog® insulin lispro/rHuPH20 administered $1^{st}$ (1) or $2^{nd}$ (2) and both (all)), and a statistical summary demonstrating that the dosing sequence did not have an effect on the observed pharmacokinetics. The statistical analysis determined the p-value of the difference in the PK observed using the different treatment groups (i.e. Humalog® insulin lispro alone versus Humalog® insulin lispro/rHuPH20), and the difference in the PK observed using the different dosing sequences (i.e. Humalog® insulin lispro alone first and then the Humalog® insulin lispro/rHuPH20, versus Humalog® insulin lispro/rHuPH20 first and then Humalog® insulin lispro alone). Also provided in the table is the relative bioavalability ($F_{rel}$) which is calculated as the [$AUC_{0-360}$ (Humalog® insulin/rHuPH20)]/[$AUC_{0-360}$ (Humalog® insulin alone]*100.

For insulin PK, median $t_{max}$ was reduced by 54% with the co-administration of rHuPH20, from 105 to 48 min (p=0.0006), an effect seen in all 12 subjects. Mean $C_{max}$ increased 87% from 697 pmol/L when subjects were administered only Humalog® insulin lispro to 1,300 pmol/L (p=0.0003) with co-administration of rHuPH20. $AUC_{0-360min}$ increased 11% from 134,867 to 149,523 min*pmol/L, whereas at earlier time intervals differences were more pronounced (i.e. $AUC_{0-30min}$ and $AUC_{0-60min}$ increased 155% and 140%, respectively). Inter-subject variability (SD/Mean) in $t_{max}$ improved from 34% when subjects received Humalog® insulin lispro alone to 17% when subjects received Humalog® insulin lispro in combination with rHuPH20. This example demonstrates that Humalog® insulin lispro, by coadministration with a hyaluronan degrading enzyme (rHuPH20) was rendered a super fast-acting insulin as described here.

TABLE 7

Pharmacokinetics of insulin following subcutaneous Humalog® insulin lispro injection with and without co-administration of rHuPH20

| Treatment | Subject_ID | $C_{max}$ (pmol/L) | $t_{max}$ (min) | $AUC_{0-360}$ (min * pmol/L) | $F_{rel}$ (%) |
|---|---|---|---|---|---|
| Humalog® Only | 1 | 590 | 105 | 136000 | |
| | 2 | 496 | 57 | 126000 | |
| | 3 | 562 | 105 | 106000 | |
| | 4 | 721 | 90 | 150000 | |
| | 5 | 972 | 54 | 154000 | |
| | 6 | 449 | 150 | 105000 | |
| | 7 | 1770 | 39 | 174000 | |
| | 8 | 795 | 75 | 156000 | |
| | 9 | 672 | 120 | 138000 | |
| | 10 | 502 | 120 | 113000 | |
| | 11 | 851 | 105 | 183000 | |
| | 12 | 631 | 150 | 160000 | |
| | N | 12 | 12 | 12 | |
| | Mean | 751 | 98 | 142000 | |
| | SD | 357 | 36 | 25600 | |
| | Median | 652 | 105 | 144000 | |
| | Geometric Mean | 697 | 91 | 139000 | |
| | CV % Geometric Mean | 38.8 | 44 | 18.8 | |
| Humalog® with rHuPH20 | 1 | 1090 | 54 | 192000 | 141 |
| | 2 | 1310 | 57 | 161000 | 128 |
| | 3 | 1640 | 48 | 172000 | 162 |
| | 4 | 853 | 48 | 146000 | 97 |
| | 5 | 1140 | 45 | 130000 | 84 |
| | 6 | 971 | 57 | 139000 | 132 |
| | 7 | 2000 | 30 | 152000 | 87 |
| | 8 | 2420 | 48 | 186000 | 119 |
| | 9 | 1320 | 45 | 135000 | 98 |
| | 10 | 930 | 57 | 123000 | 109 |
| | 11 | 1590 | 39 | 189000 | 103 |
| | 12 | 1080 | 48 | 179000 | 112 |
| | N | 12 | 12 | 12 | 12 |
| | Mean | 1360 | 48 | 159000 | 114 |
| | SD | 473 | 8 | 24500 | 23 |
| | Median | 1230 | 48 | 157000 | 110 |
| | Geometric Mean | 1300 | 47 | 157000 | 112 |
| | CV % Geometric Mean | 32.8 | 19 | 15.7 | |

TABLE 8

Time interval AUC on Geometric Mean Insulin Concentrations for Humalog ® insulin lispro alone or Co-Administered with rHuPH20

| | AUC (min * pmol/L) | | |
|---|---|---|---|
| Time Interval | Humalog ® Only | Humalog ® with rHuPH20 | Percentage Difference[a] |
| 0-15 | 1287 | 2197 | 70.7 |
| 0-21 | 2104 | 4271 | 103.0 |
| 0-30 | 3879 | 9895 | 155.1 |
| 0-45 | 9344 | 24903 | 166.5 |
| 0-60 | 16954 | 40172 | 136.9 |
| 0-75 | 24923 | 54335 | 118.0 |
| 0-90 | 33193 | 67077 | 102.1 |
| 0-120 | 50026 | 87300 | 74.5 |
| 0-150 | 66052 | 101781 | 54.1 |
| 0-180 | 80650 | 112610 | 39.6 |
| 0-360 | 134867 | 149523 | 10.8 |

[a]Percentage Difference: $(AUC_{0-x\ [rHuPH20]} - AUC_{0-x\ [no\ rHuPH20]})/(AUC_{0-x\ [no\ rHuPH20]})$

TABLE 9

Effect of Humalog ® insulin lispro dosing sequence on observed pharmacokinetics.

| Treatment | Dosing sequence | | $C_{max}$ | $t_{max}$ | $AUC_{all}$ |
|---|---|---|---|---|---|
| Humalog ® | 1 | mean | 688 | 94 | 140000 |
| | | SD | 172 | 38 | 21000 |
| | | SE | 70 | 16 | 8600 |
| | 2 | mean | 814 | 102 | 143500 |
| | | SD | 491 | 37 | 31600 |
| | | SE | 200 | 15 | 12900 |
| | All | mean | 751 | 98 | 141800 |
| | | SD | 357 | 36 | 25700 |
| | | SE | 103 | 10 | 7400 |

TABLE 9-continued

Effect of Humalog ® insulin lispro dosing sequence on observed pharmacokinetics.

| Treatment | Dosing sequence | | $C_{max}$ | $t_{max}$ | $AUC_{all}$ |
|---|---|---|---|---|---|
| Humalog ® with rHuPH20 | 1 | mean | 1239 | 48 | 156800 |
| | | SD | 456 | 11 | 27800 |
| | | SE | 186 | 4 | 11400 |
| | 2 | mean | 1485 | 49 | 160500 |
| | | SD | 498 | 4 | 23300 |
| | | SE | 203 | 2 | 9500 |
| | All | mean | 1362 | 48 | 158700 |
| | | SD | 473 | 8 | 24500 |
| | | SE | 137 | 2 | 7100 |
| Treatment Difference p-value | | | 0.0003 | 0.0006 | 0.0760 |
| Sequence Group Effect p-value | | | 0.7889 | 0.7783 | 0.9948 |

2. Effect of Co-Administration of rHuPH20 and Humulin® R Insulin on Insulin Pharmacokinetics In stage 2, patients received either the Humulin® R insulin/rHuPH20 dose first and the Humulin® R insulin alone dose second, or the Humulin® R insulin alone dose first and then the Humulin® R insulin/rHuPH20 dose usually 7 days later. The concentration of insulin at each time point following administration of Humulin® R insulin or Humulin® R insulin co-administered with rHuPH20 is provided in Tables 10 and 11, respectively. The AUC for the different time intervals (i.e. AUC for 0 to x minutes ($AUC_{(0-x)}$); e.g. $AUC_{0-3\ minutes}$, $AUC_{0-6}$ minutes, $AUC_{0-9}$ minutes, etc.) (Tables 10, 11, and 12), as is the relative bioavalability ($F_{rel}$), which is calculated as the $[AUC_{0-x}$ (Humulin® R insulin/rHuPH20)]/$[AUC_{0-x}$ (Humulin® R insulin alone]*100. The incremental slope, which is determined by calculating the change in geometric mean insulin levels over a time interval, also is presented, as is the average slope change, which is a smoothed average of five values of the incremental slope.

TABLE 10

Insulin concentration in the blood following Humulin ® R insulin administration
Immunoreactive insulin (pmol/L)

| Time (mins) | Mean | Median | SD | SE | GeoMean | Incremental Slope | AUC (0-x) | Slope Change (avg) |
|---|---|---|---|---|---|---|---|---|
| 0 | 67.4 | 59.2 | 29.8 | 8.3 | 62.4 | | | |
| 3 | 62.3 | 59.5 | 26.9 | 7.5 | 58.3 | -1.38 | 181 | |
| 6 | 70.3 | 62.8 | 29.7 | 8.2 | 65.4 | 2.37 | 366 | |
| 9 | 70.1 | 64.9 | 26.1 | 7.2 | 66.0 | 0.22 | 564 | 0.75 |
| 12 | 71.1 | 66.3 | 28.8 | 8.0 | 66.5 | 0.15 | 762 | 1.72 |
| 15 | 79.2 | 74.8 | 32.3 | 9.0 | 73.6 | 2.38 | 973 | 2.18 |
| 18 | 89.8 | 86.8 | 34.2 | 9.5 | 84.1 | 3.47 | 1209 | 3.29 |
| 21 | 104.2 | 103.4 | 36.5 | 10.1 | 98.1 | 4.68 | 1482 | 4.92 |

TABLE 10-continued

Insulin concentration in the blood following Humulin ® R insulin administration
Immunoreactive insulin (pmol/L)

| Time (mins) | Mean | Median | SD | SE | GeoMean | Incremental Slope | AUC (0-x) | Slope Change (avg) |
|---|---|---|---|---|---|---|---|---|
| 24 | 123.3 | 130.5 | 46.1 | 13.9 | 115.3 | 5.75 | 1802 | 6.39 |
| 27 | 149.8 | 143.2 | 57.6 | 16.0 | 140.2 | 8.3 | 2186 | 7.59 |
| 30 | 179.4 | 171.3 | 59.6 | 16.5 | 169.5 | 9.75 | 2650 | 7.45 |
| 33 | 208.9 | 202.8 | 69.9 | 19.4 | 198.0 | 9.5 | 3202 | 8.02 |
| 36 | 223.9 | 238.6 | 79.6 | 22.1 | 209.9 | 3.97 | 3813 | 7.30 |
| 39 | 248.3 | 231.6 | 78.7 | 21.8 | 235.6 | 8.57 | 4482 | 6.12 |
| 42 | 261.4 | 265.9 | 79.7 | 22.1 | 249.8 | 4.74 | 5210 | 4.57 |
| 45 | 272.3 | 274.1 | 78.1 | 21.7 | 261.2 | 3.81 | 5976 | 3.90 |
| 48 | 279.8 | 280.0 | 87.6 | 24.3 | 266.6 | 1.78 | 6768 | 3.00 |
| 51 | 278.6 | 262.5 | 77.2 | 21.4 | 268.4 | 0.59 | 7570 | 3.04 |
| 54 | 292.2 | 255.0 | 84.3 | 23.4 | 280.5 | 4.06 | 8394 | 2.49 |
| 57 | 313.7 | 278.3 | 110.6 | 30.7 | 295.4 | 4.95 | 9258 | |
| 60 | 316.2 | 280.3 | 111.2 | 30.8 | 298.6 | 1.05 | 10149 | |
| 75 | 349.0 | 320.4 | 132.7 | 36.8 | 325.5 | 1.79 | 14829 | |
| 90 | 358.0 | 298.9 | 152.1 | 42.2 | 329.5 | 0.27 | 19741 | |
| 105 | 364.8 | 363.6 | 128.5 | 35.6 | 344.9 | 1.03 | 24798 | |
| 120 | 372.9 | 339.6 | 111.2 | 30.8 | 358.8 | 0.92 | 30076 | |
| 135 | 400.8 | 402.8 | 123.6 | 34.3 | 382.6 | 1.59 | 35636 | |
| 150 | 423.1 | 490.9 | 165.2 | 45.8 | 391.9 | 0.62 | 41445 | |
| 165 | 423.9 | 424.9 | 164.1 | 45.5 | 392.6 | 0.04 | 47329 | |
| 180 | 412.6 | 447.9 | 148.0 | 41.1 | 386.2 | −0.43 | 53169 | |
| 240 | 336.0 | 309.9 | 90.4 | 26.1 | 325.8 | −1.01 | 74528 | |
| 300 | 308.6 | 292.8 | 77.0 | 21.4 | 299.7 | −0.43 | 93292 | |
| 360 | 242.9 | 238.7 | 64.5 | 17.9 | 234.5 | −1.09 | 109319 | |

TABLE 11

Insulin concentration in the blood following Co-Administration of Humulin ® R insulin and rHuPH20
Immunoreactive insulin (pmol/L)

| Time (mins) | Mean | Median | SD | SE | Geo-Mean | Incremental Slope | AUC (0-x) | Slope Change (avg) | $F_{rel}$ |
|---|---|---|---|---|---|---|---|---|---|
| 0 | 55.0 | 56.9 | 14.6 | 4.1 | 53.2 | | | | |
| 3 | 94.7 | 95.6 | 20.3 | 5.6 | 92.5 | 13.08 | 219 | | 121 |
| 6 | 148.3 | 142.9 | 40.6 | 11.3 | 141.7 | 16.42 | 570 | | 156 |
| 9 | 194.2 | 174.7 | 43.7 | 12.1 | 189.9 | 16.07 | 1067 | 13.2 | 189 |
| 12 | 223.1 | 227.3 | 66.1 | 18.3 | 213.2 | 7.76 | 1672 | 16.3 | 219 |
| 15 | 262.2 | 250.1 | 75.6 | 21.0 | 251.3 | 12.69 | 2369 | 16.67 | 244 |
| 18 | 352.8 | 331.6 | 108.1 | 30.0 | 336.9 | 28.54 | 3251 | 17.25 | 269 |
| 21 | 402.0 | 381.5 | 96.6 | 26.8 | 391.7 | 18.27 | 4344 | 18.16 | 293 |
| 24 | 463.7 | 437.6 | 126.5 | 38.1 | 448.6 | 18.97 | 5605 | 10.86 | 311 |
| 27 | 504.5 | 506.6 | 135.6 | 37.6 | 485.6 | 12.33 | 7006 | 17.39 | 321 |
| 30 | 492.0 | 477.1 | 210.5 | 58.4 | 414.3 | −23.79 | 8356 | 17.64 | 315 |
| 33 | 614.5 | 620.5 | 146.8 | 40.7 | 597.8 | 61.16 | 9874 | 14.5 | 308 |
| 36 | 675.7 | 676.6 | 167.1 | 46.3 | 656.3 | 19.51 | 11755 | 19.13 | 308 |
| 39 | 690.4 | 649.8 | 194.2 | 53.9 | 666.1 | 3.28 | 13739 | 21.57 | 307 |
| 42 | 805.2 | 786.4 | 244.9 | 67.9 | 772.6 | 35.49 | 15897 | 12.53 | 305 |
| 45 | 772.3 | 741.5 | 235.2 | 65.2 | 737.9 | −11.57 | 18162 | 11.13 | 304 |
| 48 | 809.8 | 811.3 | 204.4 | 56.7 | 785.7 | 15.95 | 20448 | 10.65 | 302 |
| 51 | 847.7 | 822.0 | 209.2 | 58.0 | 823.2 | 12.5 | 22861 | 6.13 | 302 |
| 54 | 854.1 | 800.2 | 222.3 | 61.6 | 825.9 | 0.88 | 25335 | 5.77 | 302 |
| 57 | 894.5 | 840.2 | 242.6 | 67.3 | 864.5 | 12.87 | 27870 | | 301 |
| 60 | 852.3 | 818.3 | 229.2 | 63.6 | 824.4 | −13.37 | 30404 | | 300 |
| 75 | 916.8 | 937.5 | 226.5 | 62.8 | 890.9 | 4.44 | 43268 | | 292 |
| 90 | 835.2 | 858.4 | 269.4 | 74.7 | 796.4 | −6.3 | 55923 | | 283 |
| 105 | 774.9 | 692.0 | 314.6 | 87.2 | 703.0 | −6.23 | 67169 | | 271 |
| 120 | 666.1 | 650.6 | 248.7 | 69.0 | 620.1 | −5.53 | 77092 | | 256 |
| 135 | 599.7 | 557.3 | 233.7 | 64.8 | 550.2 | −4.66 | 85868 | | 241 |
| 150 | 573.9 | 514.9 | 185.5 | 51.5 | 549.5 | −0.05 | 94116 | | 227 |
| 165 | 522.3 | 452.2 | 166.8 | 46.3 | 500.2 | −3.29 | 101988 | | 215 |
| 180 | 446.2 | 445.7 | 100.7 | 27.9 | 435.6 | −4.31 | 109007 | | 205 |
| 240 | 250.5 | 255.7 | 61.2 | 17.7 | 243.1 | −3.21 | 129369 | | 174 |
| 300 | 172.7 | 161.0 | 62.8 | 17.4 | 161.3 | −1.36 | 141501 | | 152 |
| 360 | 115.5 | 123.6 | 36.9 | 10.2 | 109.2 | −0.87 | 149614 | | 137 |

TABLE 12

Time interval AUC on Geometric Mean Insulin Concentrations for Humulin ® R insulin alone or Co-Administered with rHuPH20

| | AUC (min * pmol/L) | | |
|---|---|---|---|
| Time Interval | Humulin ® R Only | Humulin ® R with rHuPH20 | Percentage Difference[a] |
| 0-15 | 973 | 2369 | 143.5 |
| 0-21 | 1482 | 4344 | 193.1 |
| 0-30 | 2650 | 8356 | 215.3 |
| 0-45 | 5976 | 18162 | 203.9 |
| 0-60 | 10149 | 30404 | 199.6 |
| 0-75 | 14829 | 43268 | 191.8 |
| 0-90 | 19741 | 55923 | 183.3 |
| 0-120 | 30076 | 77092 | 156.3 |
| 0-150 | 41445 | 94116 | 127.1 |
| 0-180 | 53169 | 109007 | 105.0 |
| 0-360 | 109319 | 149614 | 36.9 |

[a]Percentage Difference: $(AUC_{0-x\ [rHuPH20]} - AUC_{0-x\ [no\ rHuPH20]})/(AUC_{0-x\ [no\ rHuPH20]})$ 3. Comparison of the Pharmacokinetics of Humalog® Insulin and Humulin® R Insulin with and without Co-Administration of rHuPH20

The pharmacokinetics of Humalog® insulin lispro and Humulin® R insulin with and without co-administration of rHuPH20 were compared. FIG. 1 presents a plot of the geometric mean (for all subjects for each composition) insulin concentrations at each time interval. For both Humalog® and Humulin® R, the concentration-time curves were shifted up (higher insulin concentrations) and to the left (a faster times). For example the geometric mean maximum insulin concentration ($C_{max}$) was almost doubled (to 1200 from 697 pmol/L) for Humalog® and more than doubled (to 967 from 433 pmol/L) for Humulin® R in the presence of rHuPH20 relative to control. Similarly, the median time to reach this maximum concentration ($t_{max}$) was reduced (from 105 to 48 minutes) for Humalog® and (from 165 to 60 minutes) for Humulin® R in the presence of rHuPH20 relative to control. This shift to higher concentrations at earlier time points is consistent with an increased rate of absorption and a constant clearance rate. Thus, co-administration of rHuPH20 increased the absorption rate of both Humalog® insulin lispro, a fast-acting insulin analog, and Humulin® R insulin, a fast-acting regular insulin.

The natural prandial insulin response includes an immediate bolus that occurs over the first 10-15 minutes after eating. This rapid rise in insulin levels provides an important physiological signal that results in shutting down the hepatic glucose release into systemic circulation. Therefore the rise in insulin concentration over 15 minutes is a particularly important parameter. The data presented above demonstrate that the geometric mean insulin lispro concentrations 15 minutes after administration of Humalog® are increased 70% from their preadministration levels (from 65 to 112 pmol/L) without rHuPH20, but upon coadministration with rHuPH20, the concentration is more than quadrupled (from 64 to 264 pmol/L). Even more dramatic, the geometric mean insulin concentration increases only slightly (from 62 to 74 pmol/L) for Humulin® R administered without rHuPH20, but are again more than quadrupled (from 53 to 251 pmol/L) when coadministered with rHuPH20. Thus coadministration with rHuPH20 provides a rapid rise in insulin concentrations that better represents the early physiological prandial insulin response in healthy individuals.

Natural prandial response continues for approximately 2 hours and provides glycemic control for mealtime carbohydrates, and therefore the cumulative systemic insulin exposure over the first approximately 2 hours is another particularly important parameter. According to the data provided herein, the cumulative area under the geometric mean insulin curve for the first two hours ($AUC_{0-120}$) was increased (from 50,000 to 87,000 min*pmol/L) for Humalog® and (from 30,000 to 77,000 min*pmol/L) for Humulin® R in the presence of rHuPH20 relative to control. Similarly the natural prandial response is effectively complete by about 4 hours after a meal, and insulin exposure a lat postprandial times can lead to hypoglycemic excursions. The corresponding exposure from 4 until the last observations at 6 hours ($AUC_{240-360}$) were reduced (from 31,000 to 20,000 min*pmol/L) for Humalog® and (from 35,000 to 20,000 min*pmol/L) for Humulin® R in the presence of rHuPH20 relative to control. Thus coadministration with rHuPH20 increased the desirable insulin exposure by 175 and 256% and decreased the undesirable insulin exposure by 67 and 58%, respectively for coadministration with rHuPH20 relative to control.

Interpatient variability in the pharmacokinetics of insulin administration require physicians to introduce patients to insulin therapy at subtherapeutic levels and progressively increase the dose to avoid overdosing a patient and risking a hypoglycemic event. The variability in pharmacokinetics can be expressed as the coefficient of variation (CV; defined as the standard deviation/mean typically expressed as a percentage) for key parameters. The CV of the maximum concentration ($C_{max}$) compared between subjects was reduced (from 48% to 35%) for Humalog® and (from 34% to 26%) for Humulin® R in the presence of rHuPH20 relative to control. The CV of the time to maximum concentration ($t_{max}$) was reduced (from 48% to 35%) for Humalog® and (from 32% to 28%) for Humulin® R in the presence of rHuPH20 relative to control. The above data demonstrate that CV of the change in insulin concentration over the first 15 minutes postadministration was reduced (from 147% to 141%) for Humalog® and (from 165% to 40%) for Humulin® R in the presence of rHuPH20 relative to control. The CV of the cumulative insulin exposure over the first 2 hours ($AUC_{0-120}$) was reduced (from 41% to 22%) for Humalog® and (from 34% to 26%) for Humulin® R in the presence of rHuPH20 relative to control. Thus the interpatient variability of insulin pharmacokinetics was reduced for insulin when coadministered with rHuPH20 relative to control.

The pharmacokinetics for Humulin® R insulin were improved by co-administration of rHuPH20 whereby the pharmacokinetics substantially resembled the pharmacokinetic profile of Humalog® insulin lispro when co-administered with rHuPH20. In particular, the rate of insulin absorption and the serum levels of insulin over the first 20 minutes were comparable between the two different types of insulin when co-administered with rHuPH20 (refer to Tables 9 and 13). In contrast, when administered without rHuPH20, Humulin® R insulin exhibits a much slower rate and decreased level of absorption compared to Humalog® insulin lispro in the early time intervals. Thus, the combination of rHuPH20, a hyaluronan degrading enzyme, and a fast-acting insulin results in compositions that act faster and to a greater extent than the fast-acting insulin alone, and, for early times (i.e. less than 20 minutes post administration), substantially independent of the type of fast-acting insulin.

D. Effect of Co-Administration of rHuPH20 on the Glucose Infusion Rate (GIR) Pharmacodynamics To assess the pharmacodynamic effect co-administration with rHuPH20 has on the glucose infusion rate (GIR), various pharmacodynamic (or glucodynamic (GD)) parameters were determined for subjects dosed with Humulin® R with and without rHuPH20. These included the time to maximal effect (tGIR$_{max}$) (minutes); the time to late half-maximal effect (tGIR$_{late\ 50\%}$) (minutes); the time to early half-maximal effect (tGIR$_{early\ 50\%}$) (minutes); the maximal metabolic effect (GIR$_{max}$) (mL/hr); AUC-GIR$_{0-60\ min}$; AUC-GIR$_{0-120\ min}$; AUC-GIR$_{0-180\ min}$; AUC-GIR$_{0-240\ min}$; AUC-GIR$_{0-300\ min}$; and the AUC-GIR$_{0-360\ min}$. GIR was expressed as milliliters of dextrose infused per hour (mL/hr), which can be converted to mg/kg/min using the following:

GIR(mg/kg/min)=[IV infusion rate(mL/hr)×dextrose concentration(g/dL)×0.0167/subjects' mass(kg), where the dextrose concentration=190.6 mg/mL.

1. Effect of Co-Administration of rHuPH20 and Humalog® Insulin on GIR Pharmacodynamics The glucose infusion rate for each time interval following administration of Humalog® insulin lispro alone or Humalog® insulin lispro/rHuPH20 was calculated and is presented in Tables 13 and 14, respectively. Also calculated were the AUC (proportional to the cumulative glucose administration) and the relative AUC (F$_{rel}$). The incremental slope, which is determined by calculating the change in GIR over a time interval, also is presented.

TABLE 13

Glucose Infusion Rates Following Humalog ® insulin lispro Administration
GIR (IV Infusion Rate, mL/hr)

| Time (mins) | Mean | Median | SD | SE | Incremental Slope (mL/hr * min) | AUC (0-x) (min * mL/hr) |
|---|---|---|---|---|---|---|
| | | (mL/hr) | | | | |
| 0 | 3.1 | 0 | 7.4 | 2.1 | | |
| 3 | 8.4 | 0 | 13.6 | 3.9 | 1.78 | 17 |
| 6 | 9.8 | 0 | 16.3 | 4.7 | 0.44 | 45 |
| 9 | 10.8 | 0 | 16.0 | 4.6 | 0.36 | 75 |
| 12 | 10.8 | 0 | 16.0 | 4.6 | 0 | 108 |
| 15 | 11.0 | 0 | 16.4 | 4.7 | 0.06 | 141 |
| 18 | 11.3 | 0 | 17.1 | 4.9 | 0.08 | 174 |
| 21 | 14.1 | 9.0 | 16.3 | 4.7 | 0.94 | 212 |
| 24 | 15.9 | 13.0 | 15.9 | 4.6 | 0.61 | 257 |
| 27 | 20.9 | 20.5 | 19.7 | 5.7 | 1.67 | 312 |
| 30 | 24.3 | 22.0 | 20.4 | 5.9 | 1.11 | 380 |
| 33 | 29.7 | 29.5 | 16.2 | 4.7 | 1.81 | 461 |
| 36 | 35.8 | 37.5 | 18.0 | 5.2 | 2.03 | 559 |
| 39 | 42.0 | 39.5 | 20.3 | 5.9 | 2.08 | 676 |
| 42 | 50.1 | 46.0 | 27.3 | 7.9 | 2.69 | 814 |
| 45 | 55.7 | 48.0 | 32.9 | 9.5 | 1.86 | 972 |
| 48 | 63.0 | 55.5 | 37.2 | 10.7 | 2.44 | 1150 |
| 51 | 68.3 | 57.5 | 42.0 | 12.1 | 1.75 | 1347 |
| 54 | 76.6 | 69.0 | 53.2 | 15.4 | 2.78 | 1565 |
| 57 | 85.7 | 75.5 | 69.4 | 20.0 | 3.03 | 1808 |
| 60 | 97.7 | 82.5 | 90.0 | 26.0 | 4 | 2083 |
| 75 | 112.3 | 80.0 | 77.2 | 22.3 | 0.97 | 3657 |
| 90 | 130.7 | 93.0 | 77.3 | 22.3 | 1.23 | 5479 |
| 105 | 142.3 | 114.0 | 73.0 | 21.1 | 0.78 | 7527 |
| 120 | 155.3 | 122.0 | 79.7 | 23.0 | 0.86 | 9759 |
| 135 | 166.4 | 143.5 | 76.1 | 22.0 | 0.74 | 12171 |
| 150 | 170.7 | 148.0 | 75.4 | 21.8 | 0.28 | 14699 |
| 165 | 175.8 | 151.5 | 74.6 | 21.5 | 0.34 | 17297 |
| 180 | 178.4 | 162.5 | 73.8 | 21.3 | 0.18 | 19954 |
| 240 | 184.9 | 167.0 | 88.3 | 25.5 | 0.11 | 30854 |
| 300 | 141.3 | 130.0 | 67.4 | 19.4 | −0.73 | 40641 |
| 360 | 110.3 | 105.0 | 50.8 | 14.7 | −0.52 | 48191 |

TABLE 14

Glucose Infusion Rates Following Co-Administration of Humalog ® insulin lispro and rHuPH20
GIR (IV Infusion Rate)

| Time (mins) | Mean | Median | SD | SE | Incremental Slope (mL/hr * min) | AUC (0-x) (min * mL/hr) | F$_{rel}$ (%) |
|---|---|---|---|---|---|---|---|
| | | (mL/hr) | | | | | |
| 0 | 5.4 | 0 | 9 | 2.6 | | | |
| 3 | 8.8 | 0 | 13.5 | 3.9 | 1.15 | 21 | 124 |
| 6 | 15.8 | 10 | 18.1 | 5.2 | 2.31 | 58 | 131 |
| 9 | 11.8 | 0 | 14.8 | 4.3 | −1.31 | 100 | 132 |
| 12 | 13.6 | 0 | 17.2 | 5.0 | 0.58 | 138 | 128 |
| 15 | 17.0 | 10 | 18.6 | 5.6 | 1.14 | 184 | 131 |
| 18 | 20.9 | 25 | 19.1 | 5.8 | 1.3 | 240 | 138 |
| 21 | 26.3 | 27 | 23.6 | 7.1 | 1.79 | 311 | 147 |
| 24 | 33.8 | 29.5 | 27.1 | 7.8 | 2.52 | 401 | 156 |
| 27 | 43.9 | 40 | 32.7 | 9.4 | 3.36 | 518 | 166 |
| 30 | 53.8 | 49.5 | 36.2 | 10.5 | 3.31 | 665 | 175 |
| 33 | 68.1 | 59 | 43.5 | 12.6 | 4.75 | 847 | 184 |
| 36 | 82.1 | 68.5 | 49.4 | 14.3 | 4.67 | 1073 | 192 |
| 39 | 104.0 | 80 | 64.5 | 18.6 | 7.31 | 1352 | 200 |
| 42 | 115.5 | 89 | 64.7 | 18.7 | 3.83 | 1681 | 207 |
| 45 | 127.9 | 96.5 | 64.1 | 18.5 | 4.14 | 2046 | 210 |
| 48 | 134.8 | 104 | 66.8 | 19.3 | 2.31 | 2440 | 212 |
| 51 | 142.6 | 107.5 | 72.1 | 20.8 | 2.58 | 2856 | 212 |
| 54 | 145.8 | 112 | 70.6 | 20.4 | 1.08 | 3289 | 210 |
| 57 | 146.8 | 121 | 60.7 | 17.5 | 0.31 | 3728 | 206 |
| 60 | 159.2 | 124.5 | 71.1 | 20.5 | 4.14 | 4187 | 201 |
| 75 | 174.6 | 138.5 | 84.8 | 24.5 | 1.03 | 6690 | 183 |
| 90 | 186.3 | 176 | 77.0 | 22.2 | 0.78 | 9397 | 172 |
| 105 | 182.3 | 147 | 78.9 | 22.8 | −0.27 | 12162 | 162 |
| 120 | 180.2 | 131.5 | 83.5 | 24.1 | −0.14 | 14881 | 152 |
| 135 | 183.8 | 132 | 88.8 | 25.6 | 0.24 | 17611 | 145 |
| 150 | 184.8 | 139 | 87.1 | 25.2 | 0.06 | 20375 | 139 |
| 165 | 185.0 | 143.5 | 88.8 | 25.6 | 0.02 | 23148 | 134 |
| 180 | 181.8 | 139.5 | 85.1 | 24.6 | −0.22 | 25899 | 130 |
| 240 | 139.7 | 129.5 | 75.1 | 21.7 | −0.7 | 35541 | 115 |
| 300 | 98.6 | 85 | 61.2 | 17.7 | −0.68 | 42689 | 105 |
| 360 | 87.7 | 65 | 62.6 | 18.1 | −0.18 | 48276 | 100 |

The GIR$_{max}$, t$_{max}$, and AUC-GIR for various time intervals also were determined for these subjects and are presented in Tables 15 and 16. Table 17 provides a summary of the PD parameters for each dosing sequence (e.g. GIR PD for Humalog® insulin lispro/rHuPH20 administered 1$^{st}$ (1) or 2$^{nd}$ (2) and both (all)), and a statistical analysis to determine whether the dosing sequence affected the observed pharmacodynamics. The statistical analysis determined the p-value of the difference in the PD observed using the different treatment groups (i.e. Humalog® insulin lispro alone versus Humalog® insulin lispro/rHuPH20), and the difference in the PK observed using the different dosing sequences (i.e. Humalog® insulin lispro alone first and then the Humalog® insulin lispro/rHuPH20, versus Humalog® insulin lispro/rHuPH20 first and then Humalog® insulin lispro alone).

TABLE 15

Pharmacodynamics of insulin following subcutaneous Humalog ® insulin lispro injection with and without co-administration of rHuPH20

| Treatment | Subject ID | GIR$_{max}$ | 50% GIR$_{max}$ | tGIR$_{early50\%}$ (min) | tGIR$_{late50\%}$ (min) |
|---|---|---|---|---|---|
| Humalog ® Only | 1 | 137 | 68.5 | 83 | NC |
| | 2 | 326 | 163 | 98 | NC |
| | 3 | 247 | 124 | 68 | NC |
| | 4 | 178 | 89.0 | 83 | NC |
| | 5 | 119 | 59.5 | 68 | 330 |
| | 6 | 158 | 79.0 | 98 | NC |
| | 7 | 350 | 175 | 53 | 270 |
| | 8 | 90.0 | 45.0 | 47 | NC |

TABLE 15-continued

Pharmacodynamics of insulin following subcutaneous Humalog ® insulin lispro injection with and without co-administration of rHuPH20

| Treatment | Subject ID | $GIR_{max}$ | 50% $GIR_{max}$ | $tGIR_{early50\%}$ (min) | $tGIR_{late50\%}$ (min) |
|---|---|---|---|---|---|
| | 9 | 115 | 57.5 | 83 | 330 |
| | 10 | 180 | 90.0 | 68 | 330 |
| | 11 | 132 | 66.0 | 56 | NC |
| | 12 | 382 | 191 | 68 | 330 |
| | N | 12 | 12 | 12 | 5 |
| | Mean | 201 | 101 | 72 | 318 |
| | SD | 100 | 50.2 | 17 | 27 |
| | SE | 29.0 | 14.5 | 5 | 12 |
| | Median | 168 | 84.0 | 68 | 330 |
| | Geometric Mean | 181 | 90.4 | 70 | 317 |
| | CV % Geometric Mean | 50.5 | 50.5 | 24 | 9 |
| Humalog ® with rHuPH20 | 1 | 126 | 63.0 | 44 | 270 |
| | 2 | 320 | 160 | 32 | 270 |
| | 3 | 385 | 193 | 44 | 270 |
| | 4 | 200 | 100 | 83 | 360 |
| | 5 | 149 | 74.5 | 50 | 270 |
| | 6 | 260 | 130 | NC | NC |
| | 7 | 223 | 112 | 26 | 330 |
| | 8 | 109 | 54.5 | 29 | 210 |
| | 9 | 154 | 77.0 | 42 | 210 |
| | 10 | 257 | 129 | 38 | 270 |
| | 11 | 138 | 69.0 | 38 | NC |
| | 12 | 336 | 168 | 47 | 330 |
| | N | 12 | 12 | 11 | 10 |
| | Mean | 221 | 111 | 43 | 279 |
| | SD | 91.1 | 45.6 | 15 | 49 |
| | SE | 26.3 | 13.2 | 5 | 16 |
| | Median | 212 | 106 | 42 | 270 |
| | Geometric Mean | 205 | 102 | 41 | 275 |
| | CV % Geometric Mean | 43.8 | 43.8 | 32 | 18 |

NC = not calculated

TABLE 16

Pharmacodynamics of insulin following subcutaneous Humalog ® insulin lispro injection with and without co-administration of rHuPH20-Interval GIR-AUC.

| | | | | GIR AUC (min * mL/hr) | | | | |
|---|---|---|---|---|---|---|---|---|
| Treatment | Subject ID | $GIR_{max}$ | $t_{max}$ | 0-60 min | 0-120 min | 0-180 min | 0-240 min | 0-360 min |
| Humalog ® | 1 | 137 | 240 | 1040 | 5400 | 13200 | 21400 | 33800 |
| | 2 | 326 | 150 | 3300 | 14000 | 33100 | 52200 | 82800 |
| | 3 | 247 | 240 | 1770 | 13500 | 27100 | 41400 | 66500 |
| | 4 | 178 | 240 | 1940 | 8570 | 18600 | 29200 | 46500 |
| | 5 | 119 | 180 | 1050 | 5340 | 11400 | 18500 | 28700 |
| | 6 | 158 | 240 | 752 | 4780 | 12600 | 21800 | 39200 |
| | 7 | 350 | 60 | 4920 | 22100 | 37600 | 50900 | 68900 |
| | 8 | 90.0 | 135 | 1490 | 5390 | 10500 | 15500 | 23100 |
| | 9 | 115 | 165 | 590 | 4200 | 10500 | 17100 | 25800 |
| | 10 | 180 | 180 | 2030 | 9090 | 18700 | 29400 | 44400 |
| | 11 | 132 | 240 | 2880 | 8070 | 14600 | 22000 | 35600 |
| | 12 | 382 | 240 | 3240 | 16700 | 31600 | 50800 | 83000 |
| | N | 12 | 12 | 12 | 12 | 12 | 12 | 12 |
| | Mean | 201 | 193 | 2080 | 9760 | 20000 | 30900 | 48200 |
| | SD | 100 | 58 | 1280 | 5640 | 9800 | 14200 | 21600 |
| | SE | 29.0 | 17 | 371 | 1630 | 2830 | 4090 | 6250 |
| | Median | 168 | 210 | 1850 | 8320 | 16600 | 25600 | 41800 |
| | Range | 292 | 180 | 4330 | 17900 | 27100 | 36800 | 59900 |
| | Geometric Mean | 181 | 181 | 1740 | 8470 | 18000 | 28100 | 44000 |
| | CV % Geometric Mean | 50.5 | 42.5 | 71.9 | 59.1 | 50.1 | 47.3 | 46.9 |
| Humalog ® with rHuPH20 | 1 | 126 | 60 | 2180 | 8600 | 15400 | 21200 | 28500 |
| | 2 | 320 | 135 | 7800 | 24500 | 43400 | 58800 | 72300 |
| | 3 | 385 | 75 | 5330 | 25800 | 43500 | 58100 | 77000 |
| | 4 | 200 | 90 | 3020 | 11400 | 19300 | 28100 | 43200 |
| | 5 | 149 | 165 | 1990 | 9250 | 17600 | 24100 | 31400 |
| | 6 | 260 | 360 | 2100 | 9780 | 16300 | 22200 | 36400 |
| | 7 | 223 | 135 | 6590 | 19300 | 32200 | 42400 | 55500 |
| | 8 | 109 | 57 | 3670 | 10200 | 15900 | 19900 | 24200 |
| | 9 | 154 | 75 | 2250 | 10300 | 16500 | 21300 | 27300 |
| | 10 | 257 | 150 | 6070 | 18800 | 34000 | 48100 | 62600 |
| | 11 | 138 | 165 | 3640 | 10600 | 18700 | 26000 | 36800 |
| | 12 | 336 | 165 | 5610 | 19900 | 38200 | 56300 | 84100 |
| | N | 12 | 12 | 12 | 12 | 12 | 12 | 12 |
| | Mean | 221 | 136 | 4190 | 14900 | 25900 | 35500 | 48300 |
| | SD | 91.1 | 82 | 2010 | 6350 | 11400 | 15900 | 21200 |
| | SE | 26.3 | 24 | 582 | 1830 | 3290 | 4600 | 6120 |
| | Median | 212 | 135 | 3650 | 11000 | 19000 | 27000 | 40000 |
| | Range | 276 | 303 | 5810 | 17200 | 28100 | 38900 | 59800 |

TABLE 16-continued

Pharmacodynamics of insulin following subcutaneous Humalog ® insulin lispro injection with and without co-administration of rHuPH20-Interval GIR-AUC.

| Treatment | Subject ID | GIR$_{max}$ | t$_{max}$ | GIR AUC (min * mL/hr) | | | | |
|---|---|---|---|---|---|---|---|---|
| | | | | 0-60 min | 0-120 min | 0-180 min | 0-240 min | 0-360 min |
| | Geometric Mean | 205 | 118 | 3750 | 13700 | 23800 | 32500 | 44200 |
| | CV % Geometric Mean | 43.8 | 57.5 | 52.9 | 42.8 | 44.6 | 46.1 | 46.0 |

TABLE 17

Effect of Humalog ® insulin lispro dosing sequence on observed pharmacodynamics.

| Treatment | Dosing Sequence | | C$_{max}$ | t$_{max}$ | GIR AUC (min * mL/hr) | | | | |
|---|---|---|---|---|---|---|---|---|---|
| | | | | | 0-60 min | 0-120 min | 0-180 min | 0-240 min | 0-360 min |
| Humalog ® alone | 1 | Mean | 213 | 185 | 1910 | 9860 | 20700 | 32580 | 51650 |
| | | SD | 123 | 45 | 1130 | 5470 | 11030 | 17460 | 28930 |
| | | SE | 50 | 18 | 460 | 2230 | 4500 | 7130 | 11810 |
| | 2 | Mean | 189 | 200 | 2260 | 9670 | 19220 | 29120 | 44730 |
| | | SD | 81 | 73 | 1510 | 6340 | 9380 | 11300 | 12810 |
| | | SE | 33 | 30 | 620 | 2590 | 3830 | 4610 | 5230 |
| | all | Mean | 201 | 193 | 2080 | 9760 | 19960 | 30850 | 48190 |
| | | SD | 100 | 58 | 1280 | 5640 | 9790 | 14140 | 21630 |
| | | SE | 29 | 17 | 370 | 1630 | 2830 | 4080 | 6250 |
| Humalog ® and rHuPH20 | 1 | Mean | 201 | 160 | 3930 | 13080 | 22650 | 31330 | 43830 |
| | | SD | 58 | 105 | 1950 | 4720 | 8240 | 11210 | 12870 |
| | | SE | 24 | 43 | 800 | 1930 | 3370 | 4580 | 5260 |
| | 2 | Mean | 242 | 112 | 4440 | 16660 | 29180 | 39750 | 52720 |
| | | SD | 118 | 49 | 2230 | 7650 | 13860 | 19760 | 27830 |
| | | SE | 48 | 20 | 910 | 3120 | 5660 | 8070 | 11360 |
| | all | Mean | 221 | 136 | 4190 | 14870 | 25920 | 35540 | 48280 |
| | | SD | 91 | 82 | 2010 | 6340 | 11390 | 15940 | 21190 |
| | | SE | 26 | 24 | 580 | 1830 | 3290 | 4600 | 6120 |
| Treatment Difference p-value | | | 0.3502 | 0.0627 | 0.0002 | 0.0011 | 0.0044 | 0.0484 | 0.9746 |
| Sequence Group Effect p-value | | | 0.5517 | 0.3445 | 0.9365 | 0.5879 | 0.5219 | 0.5075 | 0.5403 |

Glucose infusion rate PD data supported the PK findings, showing time to maximal effect (tGIR$_{max}$) shortened by 36% when patients were administered Humalog® insulin lispro in combination with rHuPH20 (median 135 minutes) compared to Humalog® insulin lispro alone (median 210 minutes), and maximal metabolic effect (GIR$_{max}$) increased by 13% from a mean of 181 mL/hr when subjects received Humalog® insulin lispro alone to 205 mL/hr when subjects received Humalog® insulin lispro and rHuPH20 (p=0.35). The time to early half-maximal effect (tGIR$_{Early50\%}$) was reduced by 38% from a median of 68 when patients were administered Humalog® insulin lispro alone to 42 min when patients were administered Humalog® insulin lispro in combination with rHuPH20 (p=0.0006).

2. Effect of co-administration of rHuPH20 and Humulin® R insulin on GIR pharmacodynamics In stage 2, patients received either the Humulin® R insulin/rHuPH20 dose first and the Humulin® R insulin alone dose second, or the Humulin® R insulin alone dose first and then the Humulin® R insulin/rHuPH20 dose usually 7 days later. The glucose infusion rate for each time interval following administration of Humulin® R insulin alone or Humulin® R insulin/rHuPH20 was calculated and is presented in Tables 18 and 19, respectively. Also calculated were the AUC and the relative amount of glucose infused over various times (Gre). The incremental slope, which is determined by calculating the change in GIR over a time interval, also is presented.

TABLE 18

Glucose Infusion Rates Following Humulin ® R insulin Administration GIR

| Time (mins) | Mean | Median | SD | SE | Incremental Slope (mL/hr * min) | AUC (0-x) (min * mL/hr) |
|---|---|---|---|---|---|---|
| | | (mL/hr) | | | | |
| 0 | 8.5 | 0 | 11 | 3.1 | | |
| 3 | 15.0 | 7 | 17 | 4.7 | 2.17 | 35 |
| 6 | 15.7 | 12 | 17.4 | 4.8 | 0.23 | 81 |
| 9 | 18.0 | 21 | 17.8 | 4.9 | 0.77 | 132 |
| 12 | 18.8 | 21 | 17.8 | 4.9 | 0.28 | 187 |
| 15 | 20.4 | 21 | 18.9 | 5.3 | 0.51 | 246 |
| 18 | 20.5 | 21 | 19 | 5.3 | 0.05 | 307 |
| 21 | 22.2 | 21 | 18.5 | 5.1 | 0.56 | 371 |
| 24 | 22.9 | 27 | 18.2 | 5 | 0.23 | 439 |
| 27 | 24.1 | 30 | 18.5 | 5.1 | 0.38 | 510 |
| 30 | 28.4 | 30 | 21 | 5.8 | 1.44 | 588 |
| 33 | 29.3 | 32 | 20 | 5.5 | 0.31 | 675 |
| 36 | 30.9 | 32 | 19.6 | 5.4 | 0.54 | 765 |
| 39 | 32.7 | 32 | 19.8 | 5.5 | 0.59 | 861 |
| 42 | 34.8 | 34 | 20.4 | 5.7 | 0.72 | 962 |
| 45 | 40.2 | 37 | 21.6 | 6 | 1.77 | 1075 |
| 48 | 42.2 | 40 | 19.4 | 5.4 | 0.67 | 1198 |

TABLE 18-continued

Glucose Infusion Rates Following Humulin ®
R insulin Administration
GIR

| Time (mins) | Mean | Median | SD | SE | Incremental Slope (mL/hr * min) | AUC (0-x) (min * mL/hr) |
|---|---|---|---|---|---|---|
| | | (mL/hr) | | | | |
| 51 | 44.3 | 39 | 19.3 | 5.4 | 0.72 | 1328 |
| 54 | 47.8 | 47 | 17.5 | 4.8 | 1.18 | 1466 |
| 57 | 51.5 | 49 | 17.6 | 4.9 | 1.23 | 1615 |
| 60 | 56.9 | 63 | 19.3 | 5.3 | 1.79 | 1778 |
| 75 | 72.5 | 77 | 27.4 | 7.6 | 1.04 | 2749 |
| 90 | 83.6 | 85 | 41.7 | 11.6 | 0.74 | 3920 |
| 105 | 92.8 | 97 | 47.3 | 13.1 | 0.62 | 5243 |
| 120 | 102.6 | 99 | 50.1 | 13.9 | 0.65 | 6709 |
| 135 | 119.4 | 105 | 55.1 | 15.3 | 1.12 | 8374 |
| 150 | 127.5 | 109 | 57.2 | 15.9 | 0.54 | 10226 |
| 165 | 138.9 | 136 | 55.8 | 15.5 | 0.76 | 12223 |
| 180 | 146.2 | 147 | 61.5 | 17.1 | 0.48 | 14362 |
| 240 | 178.9 | 193 | 61.2 | 17 | 0.55 | 24114 |
| 300 | 172.0 | 176 | 59.1 | 16.4 | −0.12 | 34642 |
| 360 | 150.3 | 164 | 45.4 | 12.6 | −0.36 | 44311 |

TABLE 19

Glucose Infusion Rates Following Humulin ®
R insulin and rHuPH20 Administration
GIR

| Time (mins) | Mean | Median | SD | SE | Incremental Slope (mL/hr * min) | AUC (0-x) (min * mL/hr) | $G_{rel}$ (%) |
|---|---|---|---|---|---|---|---|
| | | (mL/hr) | | | | | |
| 0 | 7.4 | 0 | 12.5 | 3.5 | | | |
| 3 | 16.0 | 12 | 15 | 4.2 | 2.86 | 35 | 100 |
| 6 | 17.5 | 19 | 15.2 | 4.2 | 0.51 | 85 | 105 |
| 9 | 20.1 | 24 | 15.3 | 4.3 | 0.85 | 142 | 108 |
| 12 | 21.8 | 24 | 14.7 | 4.1 | 0.59 | 205 | 109 |
| 15 | 24.8 | 26 | 14.4 | 4 | 1 | 275 | 112 |
| 18 | 30.6 | 32 | 13.2 | 3.7 | 1.92 | 358 | 116 |
| 21 | 36.4 | 35 | 15.7 | 4.4 | 1.92 | 458 | 123 |
| 24 | 48.2 | 45 | 13.4 | 3.7 | 3.95 | 585 | 133 |
| 27 | 54.8 | 47 | 16.2 | 4.5 | 2.21 | 740 | 145 |
| 30 | 65.9 | 66 | 21.6 | 6 | 3.69 | 921 | 157 |
| 33 | 74.3 | 74 | 25.8 | 7.2 | 2.79 | 1132 | 168 |
| 36 | 82.1 | 78 | 28.4 | 7.9 | 2.59 | 1366 | 179 |
| 39 | 91.8 | 87 | 28.2 | 7.8 | 3.26 | 1627 | 189 |
| 42 | 99.8 | 91 | 33.1 | 9.2 | 2.67 | 1915 | 199 |
| 45 | 110.5 | 109 | 36.8 | 10.2 | 3.56 | 2230 | 208 |
| 48 | 121.5 | 124 | 42.4 | 11.8 | 3.67 | 2578 | 215 |
| 51 | 133.7 | 134 | 49.7 | 13.8 | 4.05 | 2961 | 223 |
| 54 | 143.4 | 145 | 54.4 | 15.1 | 3.23 | 3377 | 230 |
| 57 | 153.5 | 162 | 62.8 | 17.4 | 3.38 | 3822 | 237 |
| 60 | 164.6 | 172 | 73.8 | 20.5 | 3.69 | 4299 | 242 |
| 75 | 184.8 | 178 | 99 | 27.5 | 1.34 | 6920 | 252 |
| 90 | 179.7 | 194 | 62.1 | 17.2 | −0.34 | 9653 | 246 |
| 105 | 183.9 | 211 | 60.5 | 16.8 | 0.28 | 12380 | 236 |
| 120 | 191.1 | 220 | 64.1 | 17.8 | 0.48 | 15193 | 226 |
| 135 | 206.5 | 216 | 66 | 18.3 | 1.03 | 18174 | 217 |
| 150 | 215.5 | 206 | 64 | 17.8 | 0.6 | 21339 | 209 |
| 165 | 202.9 | 214 | 62.4 | 17.3 | −0.84 | 24477 | 200 |
| 180 | 197.4 | 214 | 57.1 | 15.8 | −0.37 | 27479 | 191 |
| 240 | 181.5 | 183 | 64.2 | 17.8 | −0.26 | 38847 | 161 |
| 300 | 117.5 | 116 | 44.6 | 12.4 | −1.07 | 47819 | 138 |
| 360 | 86.5 | 80 | 28.7 | 8 | −0.52 | 53939 | 122 |

3. Comparison of the Pharmacodynamics of Humalog® Insulin Lispro and Humulin® R Insulin with and without Co-Administration of rHuPH20

The pharmacodynamics of Humalog® insulin lispro and Humulin® R insulin with and without co-administration of rHuPH20 were compared. The relative effect of co-administration of rHuPH20 on the pharmacodynamics of each type of insulin was assessed. FIG. 2 presents a plot of the glucose infusion rates at each time interval. It was observed that co-administration of rHuPH20 and Humalog® or Humulin® R markedly shifted the glucose infusion rates as a function of time up and to the left compared to when the insulins were administered without rHuPH20, similar to the shift in insulin concentration as a function of time plots. The maximum infusion rate was increased slightly from a mean of 201 to 221 mL/hr for Humalog® and 187 to 203 mL/hr for Humulin® R coadministered with rHuPH20 relative to control. Similarly, the time of maximum GIR was reduced from 193 to 136 minutes for Humalog® and 253 to 206 minutes for Humulin® R coadministered with rHuPH20 relative to control. The onset of action, as measured by the time to early half-maximal GIR (tGIR$_{early\ 50\%}$) was reduced from 72 to 43 minutes for Humalog® and 113 to 83 minutes for Humulin® R coadministered with rHuPH20 relative to control.

Mealtime carbohydrates are largely digested and introduced into the systemic circulation over the first few (e.g. two to four) hours after a meal depending on the type of carbohydrate, and thus the cumulative GIR over the first 2 or 3 hours (e.g. from 0 to 120 minutes) is particularly relevant. The cumulative volume of a 190.6 mg/mL glucose solution delivered over the first 2 hours increased from 163 to 248 mL for Humalog® and 112 to 226 mL for Humulin® R coadministered with rHuPH20 relative to control. Excess glucose metabolism after the mealtime carbohydrates digestion is complete can lead to adverse hypoglycemic incidents. The cumulative volume of glucose solution delivered from 4 to 6 hours decreased from 289 to 212 mL for Humalog® and 337 to 252 mL for Humulin® R coadministered with rHuPH20 relative to control. Thus coadministration of either a fast-acting insulin analog or a fast-acting regular insulin preparation with rHuPH20 increases the glucose lowering capacity early to facilitate postprandial digestion and decreases the glucose lowering activity when that activity could lead to hypoglycemic excursions.

The GIR is a reflection of the amount of glucose being used by the body (i.e. more exogenous glucose needs to be infused to maintain blood glucose levels between 90-110 mg/dL when the body is using more glucose), and, therefore, the pharmacological activity of the administered insulin (i.e. insulin activity results in reduced endogenous glucose output and/or increased blood glucose utilization, resulting in an overall decline of blood glucose). Thus, these data demonstrate that the biological action of each of the insulins was substantially increased both in speed (onset of glucose metabolism) and extent when co-administered with rHuPH20, a hyaluronan degrading enzyme, compared to when the insulins were administered without rHuPH20.

In this study, the pharmacodynamic properties of Humulin® R insulin when co-administered with rHuPH20 were improved whereby the pharmacodynamics substantially resembled the pharmacodynamic profile of Humalog® when co-administered with rHuPH20, in contrast to the substantially delayed pharmacodynamic properties of Humulin® R insulin relative to Humalog® insulin lispro administered in the absence of rHuPH20. The GIR required to keep blood glucose levels between 90-110 mg/dL over the first 60 minutes, and, by extension, the pharmacological activity of the insulin, particularly in the first 60-90 minutes following injection, was essentially the same between the two different types of insulin when co-administered with rHuPH20. In contrast, Humulin® R insulin, which is a fast-acting regular insulin, when administered without rHuPH20 has a GIR profile that indicates a slower rate of insulin action compared to Humalog® insulin lispro insulin when administered without rHuPH20. Thus, the combination of rHuPH20, a hyaluronan degrading enzyme, and a fast-acting insulin under, for example, conditions such as those described in this study results in super fast-acting insulin compositions that act faster and to a greater extent than the fast-acting insulin alone, and, for early times (i.e. less than 60 minutes post administration), substantially independent of the type of fast-acting insulin.

Example 1b

Pharmacokinetics and Postprandial Glycemic Response of Subcutaneously

Injected Humalog® Insulin Lispro or Humulin® R Insulin with and without Co-Administration of rHuPH20 Following a Liquid Meal in Patients with Type 1 Diabetes Mellitus A study evaluating the pharmacokinetics (PK) and post-prandial glycemic response (i.e. the pharmacodynamics (PD)) of subcutaneously injected Humalog® insulin lispro and Humulin® R insulin, with and without co-injection of rHuPH20, following a liquid meal in patients with Type 1 Diabetes Mellitus was performed. The study was a single-blind (blinded to patients only), single-center, crossover, liquid meal trial, consisting of a series of standardized liquid meal challenges, in Type 1 diabetic patients with 2 hours of pre-dosing and 8 hours of post-dosing blood sampling for PK and PD parameters.

Each subject underwent a series of dose-finding visits for Humalog® insulin lispro and rHuPH20 (Visits 2A-C; up to three injections) to determine the appropriate individual insulin dose when co-injected with rHuPH20 to cover the liquid meal at optimal glycemic control (defined as maintaining the patient's postprandial blood glucose within a range of 60 mg/dL and 160 mg/dL). Once determined, this same optimized dose was employed for a test meal that was covered by Humalog® insulin lispro without rHuPH20 (Visit 3). The subjects then underwent the same series of investigations (Visits 4A-B; up to two injections) using regular human insulin (Humulin® R insulin), to determine the appropriate individual regular insulin dose with rHuPH20 for optimal glycemic control. The same optimized dose was employed for a test meal that was covered by Humulin® R insulin without rHuPH20 (Visit 5).

The study allowed comparison of PK profiles and post-prandial glucose excursions when prandial insulin was administered with or without rHuPH20. Postmeal hypoglycemia also was assessed to verify the clinical relevance of any observed PK differences. The primary objective was to compare the early insulin exposure as measured by the primary pharmacokinetic (PK) endpoint of $AUC_0O_{60}$ of Humalog® insulin lispro and Humulin® R insulin injected subcutaneously (SC) before a liquid meal with and without recombinant human hyaluronidase (rHuPH20). Other insulin PK parameters measured included $C_{max}$; $t_{max}$; early $t_{50\%}$ (time to early half maximal serum concentration), late $t_{50\%}$ (time to late half maximal serum concentration, $AUC_{last}$ (area under the concentration-time curve from time 0 to the last observation, which according to protocol is 480 minutes postdose); $AUC_{(0-inf)}$ (total AUC from time 0 to infinity); Interval AUCs (0-15, 0-30, 0-45, 0-60, 0-90, 0-120, 0-180, 0-240, 0-360, 0-480, 15-480, 30-480, 45-480, 60-480, 90-480, 120-480, 180-480 and 240-480 minutes). λz (terminal elimination rate constant; determined by linear regression of the terminal points of the log-linear serum concentration-time curve); t½ (elimination half-life, defined as 0.693/λz); CL/F (clearance as a function of bioavailability; calculated as Dose/AUC(0-inf)); MRT(last) (mean residence time from time 0 to the last observation, which according to the protocol is 480 minutes postdose); MRT(0-inf) (mean residence time from time 0 to infinity), and Vz/F volume of distribution as a function of bioavailability).

Pharmacodynamic (PD) endpoints were postprandial glycemic response parameters, including $AUC_{BG\ 0-4h}$ (where BG denotes blood glucose), and other PD endpoints including $AUC_{BG}$ at specified time intervals, $BG_{max}$, $t_{BGmax}$, early $t_{BG\ 50\%}$, late $t_{ag\ 50\%}$, hypoglycemic episodes (HE) at specified time intervals, infusion of 20% glucose solution (amount and duration) to treat hypoglycemia, use of 50% glucose solution for emergency resuscitation (i.e. presence of severe symptoms and/or blood glucose <36 mg/dL) and hypoglycemic excursions as quantified by AUC above blood glucose 36 mg/dL and below 70 mg/dL. Safety parameters such as adverse events, hematology, biochemistry, urinalyses, physical examinations, vital signs, ECGs, blood glucose, local tolerability at injection site, and antibody formation to insulin agents and to rHuPH20 also were assessed.

A. Patient Selection

Male and female patients with Type 1 diabetes mellitus, treated with insulin for ≧12 months, were eligible for inclusion in the study. The patients were required to be 18 to 65 years old. Females of child-bearing potential were required to use a standard and effective means of birth control for the duration of the study. Other inclusion criteria included: BMI 18.0 to 29.0 kg/m², inclusive; HbAlc (glycosylated hemoglobin Alc)≦10% based on local laboratory results; Fasting C-peptide <0.6 ng/mL; Current treatment with insulin <1.2 U/kg/day. Patients also were required to be in good general health based on medical history and physical examination, without medical conditions that might prevent the completion of study drug injections and assessments required in this protocol.

The various study exclusion criteria included: known or suspected allergy to any component of any of the study drugs in the trial; previous enrollment in the trial; patients with proliferative retinopathy or maculopathy, and/or severe neuropathy, in particular autonomic neuropathy; clinically significant active disease of the gastrointestinal, cardiovascular (including a history of arrhythmia or conduction delays on ECG), hepatic, neurological, renal, genitourinary, or hematological systems, or uncontrolled hypertension (diastolic blood pressure≧100 mmHg and/or systolic blood pressure≧160 mmHg after 5 minutes in the supine position); history of any illness or disease that might confound the results of the trial or pose additional risk in administering the study drugs to the patient; clinically significant findings in routine laboratory data; anemia with hemoglobin less than lower limits of normal at screening is specifically exclusionary; use of drugs that may interfere with the interpretation of trial results or are known to cause clinically relevant interference with insulin action, glucose utilization, or recovery from hypoglycemia; recurrent major hypoglycemia or hypoglycemic unawareness, as judged by the Investigator; current addiction to alcohol or substances of abuse; blood donation (>500 mL) within the previous 9 weeks prior to Visit 2A (see section B, below) on study; pregnancy, breast-feeding, the intention of becoming pregnant, or not using adequate contraceptive measures (adequate contraceptive measures consist of sterilization, intra-uterine device [IUD], oral or injectable contraceptives or barrier methods); mental incapacity, unwillingness, or language barriers precluding adequate understanding or cooperation; symptomatic gastroparesis; receipt of any investigational drug within 4 weeks of Visit 2A (see section B, below) in this study; any condition (intrinsic or extrinsic) that could interfere with trial participation or evaluation of data; current use of insulin pump therapy and unwilling to change to Lantus in conjunction with a short-acting insulin for the duration of the trial.

Twenty-one evaluable patients completed the trial: 14 male; 7 female; age=41.6±10.6 years; BMI=24.4±286 kg/m$^2$). An evaluable patient was a patient who completed visit 3 and visit 5 and had sufficient blood sampling and safety assessments for endpoint analyses Any patient who did not complete all protocol-specified study drug injections and/or without sufficient blood sampling and safety assessments through visit 5 was replaced by the enrollment of an additional patient.

B. Study Methods

1. Visit Procedures

Each patient attended a screening visit (Visit 1) to determine the eligibility for participation in the trial. Once enrolled, each patient had at least one and up to three dosing-finding Visits 2A-C (Humalog® insulin lispro with rHuPH20), one dosing Visit 3 (Humalog® insulin lispro alone), at least one and up to two dosing-finding Visits 4A-B (Humulin® R insulin with rHuPH20), one dosing Visit 5 (Humulin® R insulin alone), and a follow-up visit (Visit 6).

Patients on an insulin pump, NPH, or any other long acting insulin, who participated in the study, were converted to Lantus for the duration of the study. The conversion took place once the subject has passed screening assessments but at least 36 hours before their first dosing visit.

Each dose-finding visit and each dosing visit was completed in a single day. Following early morning check-in, patients were observed and stabilized for approximately 2 hours using intravenous glucose and/or insulin as required to bring blood glucose into a target value of 100 mg/dL. No insulin or glucose infusion was allowed during the 30 minutes immediately prior to dosing. This was then followed by dosing with the test article (i.e. Humalog® insulin lispro, Humalog® insulin lispro/rHuPH20, Humulin® insulin or Humulin® insulin/rHuPH20) and then consumption of the liquid meal at approximately 8:30 AM. On all dosing visits, PK and PD assessments proceeded for 8 hours until approximately 4:30 PM, at which time the patients received a meal and were discharged if judged safe.

2. Preparations for the Dose-Finding Visit Procedures

An 18-gauge catheter was inserted in the cubital vein of the same arm for analysis of serum insulin and blood glucose using YSI STAT2300 Glucose Analyzer. Blood clotting in the catheter and line was prevented by flushing with 0.15 mmol/L saline. A second 18-gauge PTFE catheter was placed in a vein of the opposite forearm for infusion of 20% glucose solution, saline, and insulin as deemed appropriate during the pre-dosing period. Sixty min prior to dosing, blood glucose concentration was determined at the following time-points relative to dosing: −60, −30, −20 and −10 min with a YSI STAT2300 Glucose Analyzer. The average of the blood glucose readings from −30, −20 and −10 min were used to determine the individual patient's fasting blood glucose level for each dose-finding and dosing visit. A patient with differences between initial fasting blood glucose values that are deemed too large was rescheduled for the visit or withdrawn from the study.

3. Pre-Dosing Period

During the run-in period of 2 hours, the blood glucose was monitored as needed to stabilize blood glucose in the target range. The 2 hour run-in period was used to adjust the blood glucose levels as appropriate by IV administration of glucose and/or insulin by means of a precision infusion/syringe pump. No insulin or glucose infusion was administered during the 30 minutes immediately prior to dosing. At the time of drug administration, the blood glucose level of the patient was in a range between 80 and 140 mg/dL (targeting a value as close to the range of 100-120 mg/dL as possible)

4. Dosing and Ingestion of Standard Liquid Meal

After the 2-hour run-in period, the study drug injection was administered (at timepoint 0) by subcutaneous injection with a syringe into a lifted skin fold of the abdominal wall. The test articles were prepared as follows. The Humulin® R insulin only dose was prepared by aspirating the correct dose (as determined at Visit 4) from a vial of Humulin® R insulin (100 U/mL; Eli Lilly) using a 0.3 cc capacity insulin syringe. The Humulin® R insulin/rHuPH20 was prepared by first aspirating 0.3 cc (150 units) from a vial of Humulin® R insulin (500 U/mL; Eli Lilly) using a 0.3 cc capacity insulin syringe and transferring it into a vial containing 1 mL rHuPH20 (20 µg/mL; 3000 U/mL). The solution was mixed by gentle swirling.

The Humalog® insulin lispro only dose was prepared by aspirating the correct dose (as determined at Visit 2) from a vial of Humalog® insulin lispro (100 U/mL; Eli Lilly) using a 0.3 cc capacity insulin syringe. The Humalog® insulin lispro/rHuPH20 was prepared by first thawing a vial of rHuPH20 (1 mg/mL; approximately 1200,000 U/mL) at room temperature for 1 to 2 hours. Using a sterile 0.3 cc capacity insulin syringe, 0.27 cc of air was drawn into the syringe and expelled in the headspace of the rHuPH20 vial, before 0.27 cc (0.27 mg; approximately 32400 U) rHuPH20 was drawn into the syringe. This was then transferred slowly, to prevent foaming, into a vial of Hylenex and gently swirled. Using a sterile 3.3 cc insulin syringe, 1.1 mL air was drawn and expelled into the headspace of the Hylenex (containing an extra 0.27 mg rHuPH20; approximately 32400 U) vial before 1.1 mL of the solution was aspirated and dispensed into a vial of Humalog® insulin lispro (100 U/mL; Eli Lilly). The solution was mixed by gentle swirling.

A mean dose of 5.7 (+3.0) Humalog® insulin lispro, with or without rHuPH20 (0.2 µgfu insulin) was administered. A mean dose of 6.2 (±3.5) Humulin® R insulin, with or without rHuPH20 (0.2 µg/U insulin) was administered. The injection sites for insulins co-administered with rHuPH20 were as follows: injection for Visit 2A was in the left mid-abdominal region, the next visit (Visit 2B or Visit 3 if Visit 2B was not necessary) used the right mid-abdominal region and the next visit used the left mid-abdominal region, with subsequent injection sites alternating accordingly. The injection needle was placed at a 45 degree angle and kept in the skin fold for 10 seconds.

Within 10 minutes after study drug dosing, the patients consumed a liquid meal (Ensure) providing 60 gm of carbohydrate. The liquid meal was fully ingested within 10 minutes. The blood glucose was measured for the next 8 hours at specified time-points. Additional blood glucose measurements for safety purposes were performed as needed.

5. Sampling and Assessment

During the pre-dosing period and following dosing, blood glucose concentration was monitored by frequent blood glucose measurements using the YSI STAT2300 Glucose Analyzer at the specified timepoints of −60, −30, −20, −10, 0, 3, 6, 9, 12, 15, 20, 25, 30, 40, 45, 50, 60, 70, 80, 90, 100, 110, 120, 130, 140, 150, 160, 170, 180, 190, 200, 210, 220, 230, 240, 255, 270, 285, 300, 315, 330, 345, 360, 375, 390, 415, 420, 430, 445, 460, 475 and 480 minutes. Serial blood samples for the determination of serum insulin were drawn at −30, −30, −10, 0, 3, 6, 9, 12, 15, 20, 30, 45, 60, 90, 120, 150, 180, 210, 240, 300, 360, 420 and 480 minutes.

B. Pharmacokinetics of Humulin® R Insulin and Humalog® Insulin Lispro with and without rHuPH20

The pharmacokinetics for both Humalog® insulin lispro/rHuPH20 and Humulin® R insulin/rHuPH20 showed accelerated but overall comparable exposure as compared to each without rHuPH20. Table 19a sets forth a summary of various PK parameters for 12 patients. This was an interim analysis that was performed before data from all patients was collected. Thus, only data from 12 of the 21 patients contributed to this analysis. The effect of co-administration with rHuPH20 is shown by % control, calculated by [mean (geometric or arithmetic) PK value for insulin with rHuPH20]/[mean (geometric or arithmetic) PK value for insulin alone]× 100), also is included. Geometric Mean and p-value for log transformed data for $C_{max}$ and AUC parameters, while based on arithmetic mean and untransformed values for $t_{max}$ and Early & Late $t_{50\%}$. The primary endpoint, total insulin exposure over the first 1 hour ($AUC_{0-60}$), was increased 135% for Humalog® insulin lispro/rHuPH20 compared to Humalog® insulin lispro alone (p=0.0197) and 304% for Humulin® R insulin/rHuPH20 over Humulin® R insulin alone (p=0.0005). Early $T_{50\%}$ decreased from 19.9 to 12.6 min (p=0.0002) for Humalog® insulin lispro and 40.1 to 14.8 (p=0.033) for Humulin® R insulin. $t_{max}$ decreased from 43.8 to 27.9 min (p=0.002) for Humalog® insulin lispro and 96.7 to 52.1 (p=0.086) for regular; Late $T_{50\%}$ decreased from 98.6 to 68.6 min (p=0.0001) for Humalog® insulin lispro and 219.2 to 11 1.2 (p=0.008) Humulin® R insulin.

TABLE 19a

Pharmacokinetics of insulin administered with or without rHuPH20 in a liquid meal study

| | Humalog ® insulin lispro (N = 12) | | | Humulin ® R insulin (N = 12) | | |
|---|---|---|---|---|---|---|
| | −rHuPH20 Median (Range) | +rHuPH20 Median (Range) | Effect of rHuPH20 % Control (p value)[a] | −rHuPH20 Median (Range) | +rHuPH20 Median (Range) | Effect of rHuPH20 % Control (p value)[a] |
| Insulin Dose (U) | 6 (3, 16) | 6 (3, 16) | | 6 (2, 18) | 6 (2, 18) | |
| early $t_{50\%}$ (min) | 20.2 (13.3, 25.6) | 13.6 (6.3, 18.2) | 63% (p = 0.0002) | 27.3 (14.6, 146.0) | 16.2 (3.9, 22.9) | 60% (p = 0.0329) |
| $t_{max}$ (min) | 45 (30, 60) | 30 (15, 45) | 67% (p = 0.0015) | 60 (20, 240) | 45 (20, 150) | 75% (p = 0.0856) |
| late $t_{50\%}$ (min) | 86.6 (69.2, 135.0) | 71.0 (42.5, 93.9) | 82% (p = 0.0001) | 172.0 (91.8, 370.0) | 104.5 (67.2, 173.0) | 61% (p = 0.0066) |
| $C_{max}$ (pmol/L * U) | 40.7 (25.5, 76.2) | 53.2 (31.2, 101.5) | 126% (p = 0.0394) | 21.1 (6.0, 52.3) | 38.5 (21.7, 76.8) | 186% (p = 0.0047) |
| AUC interval (min * pmol/L * U) | | | | | | |
| 0-60 | 1373 (947, 3113) | 2310 (1238, 3683) | 135% (p = 0.0197) | 583 (150, 1860) | 1495 (856, 3600) | 304% (p = 0.0005) |
| 0-last | 3840 (1673, 5133) | 3452 (2133, 6375) | 105% (p = 0.7332) | 3633 (745, 6500) | 4021 (2417, 5656) | 133% (p = 0.1679) |
| 0-inf | 4016 (1783, 5667) | 3491 (2167, 6650) | 102% (p = 0.9004) | 3867 (990, 11467) | 4143 (2433, 5700) | 105% (p = 0.8366) |

[a]Analysis of variance using a mixed model with fixed effect for treatment. An unstructured covariance matrix among repeated measurements, performed on log-transformed values for AUC and Cmax parameters, and untransformed data for $t_{max}$ and $t_{50\%}$ parameters. Values of 0 were set to 1 prior to log transformation.

Table 19b sets forth a summary of various PK parameters for all of the 21 patients that completed the study, showing the mean and standard deviation. The PK analyses in Table 19b were performed on baseline subtracted (where baseline was the measurement at time 0) individual Humalog® insulin lispro or Humulin® R insulin concentration versus time data using the non-compartmental approach (linear trapezoidal rule for AUC calculation). WinNonlin user selection criteria were used in the determination of Lambda z, the elimination rate constant, upon which half-life, AUC $INF_{obs}$, MRT, CL, and Vz were based. All measurements lower than 20.0 pM were set to zero for purpose of PK calculation.

The addition of rHuPH20 to Humalog® insulin lispro or Humulin® R insulin injection increased the early insulin exposure. The mean dose-normalized baseline subtracted $C_{max}$ was increased 74% from 46.6 to 81.2 pmol/L with addition rHuPH20 to Humalog® insulin lispro, and 122% from 25.4 to 56.5 pmol/L for Humulin® R insulin. For the primary PK endpoint, $AUC_{0-60min}$, co-administration with rHuPH20 increased the early Humalog® insulin lispro exposure by 75% from 1690 to 2950 min*pmol/L/IU and increased early Humulin® R insulin exposure by 210% from 649 to 2010 min*pmol/L/IU relative to control administration without enzyme. The bioavailability upon coadministration with rHuPH20 was not significantly altered relative to control injection of Humalog® insulin lispro alone: 98% for $AUC_{0-inf}$ and 116% for $AUC_{0-last}$. The relative bioavailability was 120% for $AUC_{0-inf}$ and 174% for $AUC_{0-last}$ with coadministration of Humulin® R insulin with rHuPH20 relative to control administration without enzyme (geometric mean dose-normalized baseline subtracted data used for these calculations; data not shown). Co-administration of both insulin and lispro with rHuPH20 accelerated $T_{max}$ and Early and Late $T_{50\%}$ compared with control injection without rHuPH20.

The time to peak insulin concentration was faster for Humalog® insulin lispro injection with rHuPH20, with arithmetic mean $t_{max}$ at 38.8 minutes, versus 47.1 minutes with Humalog® insulin lispro injection without rHuPH20. Subcutaneous injection of Humulin® R insulin with rHuPH20 resulted in a $t_{max}$ of 58.3 minutes, compared to 104 minutes without rHuPH20.

TABLE 19b

Pharmacokinetics of insulin administered with or without rHuPH20 in a liquid meal study

| | Humalog® insulin lispro (N = 21) | | | | Humulin® R insulin (N = 21) | | | |
| --- | --- | --- | --- | --- | --- | --- | --- | --- |
| | −rHuPH20 | | +rHuPH20 | | −rHuPH20 | | +rHuPH20 | |
| | Mean | SD | Mean | SD | Mean | SD | Mean | SD |
| Cmax (pmol/L *U) | 46.6 | 23.3 | 81.2 | 92.9 | 25.4 | 13.1 | 56.5 | 52.1 |
| AUClast (min * pmol/L * U) | 4440 | 2360 | 8470 | 19400 | 3850 | 1840 | 6570 | 8690 |
| AUC0-inf (min * pmol/L * U) | 4680 | 2580 | 4410 | 1700 | 4200 | 1620 | 4810 | 1580 |
| AUC0_15 (min * pmol/L * U) | 82.1 | 105 | 262 | 183 | 36 | 43.6 | 188 | 172 |
| AUC0_30 (min * pmol/L * U) | 485 | 394 | 1190 | 1080 | 171 | 125 | 698 | 461 |
| AUC0_45 (min * pmol/L * U) | 1080 | 681 | 2190 | 1980 | 395 | 269 | 1340 | 763 |
| AUC0_60 (min * pmol/L * U) | 1690 | 926 | 2950 | 2530 | 649 | 422 | 2010 | 1070 |
| AUC0_90 (min * pmol/L * U) | 2680 | 1320 | 4050 | 3800 | 1210 | 693 | 3140 | 1520 |
| AUC0_120 (min * pmol/L * U) | 3370 | 1620 | 4980 | 6080 | 1770 | 934 | 4050 | 2320 |
| AUC0_180 (min * pmol/L * U) | 4070 | 1900 | 5980 | 9120 | 2810 | 1170 | 4900 | 3040 |
| AUC0_240 (min * pmol/L * U) | 4310 | 2060 | 7230 | 14200 | 3560 | 1280 | 5230 | 3450 |
| AUC0_360 (min * pmol/L * U) | 4500 | 2440 | 7950 | 16900 | 4190 | 1540 | 5950 | 6040 |
| AUC0_480 (min * pmol/L * U) | 4540 | 2450 | 8520 | 19300 | 4280 | 1630 | 6910 | 9950 |
| AUC15_480 (min * pmol/L * U) | 4460 | 2360 | 8270 | 19200 | 4250 | 1620 | 6720 | 9870 |
| AUC30_480 (min * pmol/L * U) | 4050 | 2140 | 7330 | 18300 | 4110 | 1610 | 6210 | 9690 |
| AUC45_480 (min * pmol/L * U) | 3460 | 1960 | 6340 | 17500 | 3890 | 1600 | 5560 | 9480 |
| AUC60_480 (min * pmol/L * U) | 2850 | 1810 | 5570 | 16900 | 3630 | 1620 | 4890 | 9220 |
| AUC90_480 (min * pmol/L * U) | 1860 | 1490 | 4470 | 15600 | 3080 | 1600 | 3770 | 8820 |
| AUC120_480 (min * pmol/L * U) | 1160 | 1190 | 3540 | 13300 | 2520 | 1550 | 2850 | 7910 |
| AUC180_480 (min * pmol/L * U) | 473 | 782 | 2540 | 10300 | 1480 | 1350 | 2000 | 7090 |
| AUC240_480 (min * pmol/L * U) | 223 | 525 | 1300 | 5130 | 726 | 903 | 1680 | 6620 |
| Lambda_z (1/min) | 0.0214 | 0.0094 | 0.0253 | 0.00905 | 0.0224 | 0.0118 | 0.0249 | 0.0118 |

TABLE 19b-continued

Pharmacokinetics of insulin administered with or without rHuPH20 in a liquid meal study

| | Humalog ® insulin lispro (N = 21) | | | | Humulin ® R insulin (N = 21) | | | |
|---|---|---|---|---|---|---|---|---|
| | −rHuPH20 | | +rHuPH20 | | −rHuPH20 | | +rHuPH20 | |
| | Mean | SD | Mean | SD | Mean | SD | Mean | SD |
| HL__Lambda__z (min) | 38.7 | 16.3 | 31.8 | 14.1 | 40.8 | 21.4 | 36.2 | 24.8 |
| $t_{max}$ (min) | 47.1 | 15.2 | 38.8 | 40.2 | 104 | 65 | 58.3 | 32.5 |
| early $t_{50\%}$ (min) | 21.1 | 5.83 | 13.9 | 3.34 | 38.7 | 31.6 | 18.5 | 10.8 |
| late $t_{50\%}$ (min) | 112 | 30.5 | 81.9 | 45.2 | 214 | 70.7 | 118 | 30.8 |
| Vz_F_obs (L) | 87.4 | 52.2 | 67.1 | 30.2 | 117 | 141 | 70.5 | 50.5 |
| Cl_F_obs (L/min) | 1.56 | 0.668 | 1.56 | 0.582 | 1.81 | 1.27 | 1.37 | 0.435 |
| MRTlast (min) | 86.1 | 23.3 | 72.4 | 34.3 | 131 | 50.5 | 93.6 | 43.7 |
| MRTINF_obs (min) | 97.6 | 31.6 | 73.6 | 27 | 144 | 38.2 | 90.7 | 33.5 |

C. Comparison of Glycemic Response to Meal Challenge Following Regular Human Insulin and Insulin Lispro with and without rHuPH20

The glycemic response to a meal challenge was improved Humalog® insulin lispro or Humulin® R insulin was administered with rHuPH20 compared to when the insulins were administered alone. Table 19c sets forth the pharmacodynamic parameters as measured from 12 patients. Co-administration of either Humalog® insulin lispro or Humulin® R insulin with rHuPH20 resulted in reduced postprandial blood glucose levels relative to control injection without rHuPH20. The maximum blood glucose observed in the 4 hr postprandial period was reduced from 186 to 154 mg/dL when Humalog® insulin lispro was administered with rHuPH20 compared to Humalog® insulin lispro alone (p=0.0213) and from 212 to 166 mg/dL when Humulin® R insulin was administered with rHuPH20 compared to Humulin® R insulin alone (p=0.0406). 2 hr post prandial glucose (PPG) and total excursion area greater than 140 mg/dL were similarly reduced. The total excursion area less than 70 mg/dL was minimal and similar for all test articles, with a minor trend towards increased area for Humalog® insulin lispro and decreased area for Humulin® R insulin with rHuPH20 co-administration.

TABLE 19c

Pharmacodynamics of insulin administered with or without rHuPH20 in a liquid meal study

| | Humalog ® insulin lispro (N = 12) | | | Humulin ® R insulin (N = 12) | | |
|---|---|---|---|---|---|---|
| | −rHuPH20 Median (Range) | +rHuPH20 Median (Range) | % Control (p value)[a] | −rHuPH20 Median (Range) | +rHuPH20 Median (Range) | % Control (p value)[a] |
| $BG_{max}$ (mg/dL) | 186 (127, 270) | 154 (98, 196) | 83% (p = 0.0213) | 212 (128, 343) | 166 (137, 274) | 79% (p = 0.0406) |
| $t_{BGmax}$ (min) | 70 (30, 120) | 95 (20, 240) | 136% (p = 0.1854) | 90 (45, 120) | 70 (45, 140) | 78% (p = 0.5744) |
| 2 hr PPG (mg/dL) | 156 (70, 239) | 124 (74, 194) | 80% (p = 0.0862) | 192 (101, 329) | 132 (79, 207) | 69% (p = 0.0084) |
| AUC > 140 (mg * min/dL) | 3573 (0, 15758) | 400 (0, 6864) | 11% (p = 0.0693) | 5254 (0, 35013) | 847 (2, 14513) | 16% (p = 0.2105) |
| AUC < 70 (mg * min/dL) | 0 (0, 0) | 0 (0, 642) | 0% (p = 0.0958) | 347 (0, 1148) | 0 (0, 939) | 0% (p = 0.2803) |

[a]t-test, paired, 2-tailed

D. Safety

No serious adverse events (AEs) were reported. The most commonly-reported AE was decreased blood glucose/hypoglycemia (147 events). Of the 147 events of decreased blood glucose/hypoglycemia, 21 were considered possibly or probably related to rHuPH20. 17 events were rated as moderate in intensity, 4 of which were considered possibly related to rHuPH20. The remaining 126 events were rated as mild in intensity. All other AEs occurred with less than 5% frequency in this study.

All episodes of hypoglycemia (defined as having a blood glucose value of >70 mg/dL) regardless of symptoms were captured as AEs in this study.

E. Summary

Co-administration of either Humalog® insulin lispro or Humulin® R insulin with rHuPH20 resulted in earlier insulin exposure with earlier $t_{max}$, early $t_{50\%}$ and late $t_{50\%}$ parameters, as well as greater peak insulin concentration relative to control injections without rHuPH20, without a significant change in bioavailability. This earlier insulin exposure led to less postprandial hyperglycemia, with reduced peak 0-4 hr glucose levels, reduced 2 hr postprandial glucose levels, and less hyperglycemic excursions as measured by AUC>140 mg/dL. The hypoglycemic excursions, as measured by AUC<70 mg/dL, were minimal and similar for all test articles, with a minor trend towards increased area for Humalog® insulin lispro and decreased area for regular human insulin (Humulin® R insulin) upon rHuPH20 co-administration.

Example 1c

Pharmacokinetics and Pharmacodynamics of Subcutaneously Administered Humulin® R Insulin or Humalog® Insulin Lispro with or without Varying Doses of Recombinant rHuPH20 in Healthy Human Subjects As part of a single center, phase I, open-label, single-blind (subjects blinded to the contents of each injection), 4 stage study to determine the pharmacokinetics, pharmacodynamics (or glucodynamics; GD), safety, tolerability, and optimal ratio of rHuPH20:insulin, a range of rHuPH20 dose ratios were administered subcutaneously (SC) with doses of regular insulin (Humulin® R insulin) or Humalog® insulin lispro, and the pharmacokinetics (PK) and optimum ratio of rHuPH20:insulin was assessed by determining $t_{max}$, $C_{max}$, $AUC_{0\to t}$, and relative bioavailability based on serum insulin concentrations collected at specified time points.

The effect of co-administration of varying doses of rHuPH20 on pharmacokinetics and pharmacodynamics (or glucodynamics (GD)) of subcutaneously administered Humulin® R insulin or Humalog® insulin lispro was assessed by taking blood samples to measure insulin and glucose levels. A Hyperinsulinemic-Euglycemic Clamp Procedure (as described in Example 1) was used to maintain plasma glucose levels between 90-110 mg/dL. Insulin concentrations were assessed to determine the insulin PK parameters: $t_{max}$, early $t_{50\%}$, late $t_{50\%}$, $AUC_{0\to t}$ and $AUC_{t\to end}$ (where t=30, 60, 90, 120, 180, 240, 360, and 480 min after injection), $AUC_{0\to all}$, $AUC_{0\to inf}$, $C_{max}$, relative bioavailability (with compared to without rHuPH20), and inter- and intra-subject variability based on coefficient of variation for all PK parameters. The glucose infusion rate (GIR) rate to maintain euglycemia while on clamp was measured and used to determine the following GD parameters: $tGIR_{max}$, early $tGIR_{50\%}$, late $tGIR_{50\%}$, $GIR\, AUC_{0\to t}$ and $GIR\, AUC_{t\to end}$ (where t=30, 60, 90, 120, 180, 240, 360, and 480 min after injection), $GIR\, AUC_{0\to all}$, and $cGIR_{max}$, and inter- and intra-subject variability based on coefficient of variation for all GD parameters. The safety and local tolerability of each of the SC injections also was assessed.

A. Administration Humulin® R Insulin with or without Varying Doses of rHuPH20

Healthy volunteers were administered 30 μL or 120 μL of Humulin® R insulin (diluted to 100 U/mL) with a final concentration of either 0 μg/mL, 1.25 μg/mL, 5 μg/mL, 10 μg/mL, 20 μg/mL or 80 μg/mL rHuPH20 (approximately 0 U/mL, 150 U/mL, 600 U/mL, 1200 U/mL, 2400 U/mL or 9600 U/mL, respectively). Thus, the volunteers were administered either 30 μL containing 3 U Humulin® R insulin with approximately 0, 4.5, 18, 36, 72 or 288 Units rHuPH20, or 120 μL containing 12 U Humulin® R insulin with approximately 0, 18, 72, 144, 288 or 1152 Units rHuPH20. Table 19d sets forth the measured pharmacokinetic parameters for the subjects receiving 12 U insulin. The PK parameters characteristic of hyaluronidase co-administration (earlier $t_{max}$ and $t_{1/2max}$, greater $C_{max}$ and early systemic exposure e.g. $AUC_{0-60\, min}$) were increased comparably for all rHuPH20 concentrations tested compared to when insulin was administered alone. Glucose infusion rate (GIR) profiles for all rHuPH20 concentrations were different from placebo (i.e. 0 μg/mL) with a characteristic increase in early rates and decrease in late glucose infusion. Over the doses tested, all rHuPH20 concentrations were similarly effective, and a non-effective dose was not observed.

TABLE 19d

Insulin PK Parameters for 12 U Humulin ® R insulin with varying doses of rHuPH20

| Variable (Units) | Statistic | Amount of rHuPH20 | | | | | |
|---|---|---|---|---|---|---|---|
| | | 0 μg/mL | 1.25 μg/mL | 5 μg/mL | 10 μg/mL | 20 μg/mL | 80 μg/mL |
| $C_{max}$ (pmol/L) | N | 4 | 4 | 4 | 4 | 4 | 4 |
| | Geo. Mean | 192.3 | 418.1 | 355.7 | 323.4 | 371.0 | 352.2 |
| | CV % | 22.9 | 33.2 | 23.7 | 45.6 | 32.4 | 35.5 |
| | Median | 179.5 | 432.0 | 334.0 | 276.0 | 353.0 | 371.0 |
| $t_{max}$ (minutes) | N | 4 | 4 | 4 | 4 | 4 | 4 |
| | Arith. Mean (std) | 121.5 (125.42) | 108.8 (33.26) | 71.3 (14.36) | 93.8 (39.45) | 75.0 (21.21) | 101.3 (41.31) |
| | CV % | 103 | 30.6 | 20.2 | 42.1 | 28.3 | 40.8 |
| | Median | 90.0 | 105.0 | 67.5 | 82.5 | 82.5 | 97.5 |

TABLE 19d-continued

Insulin PK Parameters for 12 U Humulin ® R insulin with varying doses of rHuPH20

| Variable | | Amount of rHuPH20 | | | | | |
|---|---|---|---|---|---|---|---|
| (Units) | Statistic | 0 µg/mL | 1.25 µg/mL | 5 µg/mL | 10 µg/mL | 20 µg/mL | 80 µg/mL |
| Early $t_{50\%}$ (minutes) | N | 4 | 4 | 4 | 4 | 4 | 4 |
| | Arith. Mean | 41.3 | 33.3 | 22.3 | 30.4 | 24.7 | 33.5 |
| | (std) | (25.67) | (9.14) | (6.97) | (9.58) | (3.99) | (15.10) |
| | CV % | 62.2 | 27.4 | 31.2 | 31.5 | 16.2 | 45.1 |
| | Median | 30.3 | 33.5 | 25.4 | 29.3 | 25.0 | 34.2 |
| Late $t_{50\%}$ (minutes) | N | 4 | 4 | 4 | 4 | 4 | 4 |
| | Arith. Mean | 359.0 | 196.3 | 209.8 | 194.5 | 210.8 | 193.8 |
| | (std) | (28.28) | (47.35) | (47.08) | (69.25) | (50.09) | (43.26) |
| | CV % | 7.9 | 24.1 | 22.4 | 35.6 | 23.8 | 22.3 |
| | Median | 359.0 | 201.0 | 204.0 | 174.5 | 231.0 | 187.0 |
| $AUC_{0-60}$ (min * pmol/L) | N | 4 | 4 | 4 | 4 | 4 | 4 |
| | Geo. Mean | 4606.8 | 11299.9 | 11679.1 | 9078.3 | 12193.6 | 9514.5 |
| | CV % | 51.8 | 38.6 | 27.6 | 63.2 | 44.1 | 67.0 |
| | Median | 4635.0 | 10475.0 | 11865.0 | 7190.0 | 11425.0 | 9885.0 |
| $AUC_{last}$ (min * pmol/L) | N | 4 | 4 | 4 | 4 | 4 | 4 |
| | Geo. Mean | 59362.0 | 76639.9 | 75575.6 | 64666.6 | 70945.2 | 65635.2 |
| | CV % | 20.0 | 11.2 | 10.6 | 18.3 | 24.5 | 22.1 |
| | Median | 57750.0 | 76550.0 | 76450.0 | 64100.0 | 68150.0 | 63100.0 |

B. Administration Humalog® Insulin Lispro with or without Varying Doses of rHuPH20

Healthy volunteers were administered 30 µL or 120 µL of Humalog® insulin lispro (diluted to 50 U/mL) with a final concentration of either 0 µg/mL, 0.078 µg/mL, 0.3 µg/mL, 1.2 µg/mL, 5 µg/mL or 20 µg/mL rHuPH20 (approximately 0 U/mL, 9.36 U/mL, 36 U/mL, 144 U/mL, 600 U/mL or 2400 U/mL, respectively). Thus, the volunteers were administered either 30 µL containing 1.5 U Humaloge insulin lispro with approximately 0, 0.28, 1.08, 4.32, 18 or 72 Units rHuPH20, or 120 µL containing 6 U Humalog® insulin lispro with approximately 0, 1.12, 4.32, 17.28, 72 or 288 Units rHuPH20. Table 19e sets forth the measured pharmacokinetic parameters for the subjects receiving 6 U Humalog® insulin lispro. Over the doses tested, all rHuPH20 concentrations greater than 0.3 µg/mL were similarly effective.

TABLE 19e

Insulin PK Parameters for 6 U Humalog ® insulin lispro with varying doses of rHuPH20

| Variable | | Amount of rHuPH20 | | | | | |
|---|---|---|---|---|---|---|---|
| (units) | Statistic | 0 µg/mL | 0.08 µg/mL | 0.31 µg/mL | 1.25 µg/mL | 5 µg/mL | 20 µg/mL |
| $C_{max}$ (pmol/L) | N | 4 | 4 | 4 | 4 | 4 | 4 |
| | Geo. Mean | 381.8 | 355.9 | 435.1 | 483.7 | 579.5 | 463.6 |
| | CV % | 13 | 21 | 26 | 23 | 29 | 32 |
| | Median | 385 | 376 | 463 | 506 | 532 | 438.8 |
| $t_{max}$ (minutes) | N | 4 | 4 | 4 | 4 | 4 | 4 |
| | Arith. Mean | 67.5 | 36.3 | 33.8 | 41.3 | 33.8 | 40.0 |
| | (std) | (8.7) | (10.3) | (7.5) | (14.4) | (7.5) | (15.8) |
| | CV % | 13 | 28 | 22 | 35 | 22 | 40 |
| | Median | 67.5 | 37.5 | 30 | 37.5 | 30 | 37.5 |
| Early $t_{50\%}$ (minutes) | N | 4 | 4 | 4 | 4 | 4 | 4 |
| | Arith. Mean | 25.9 | 15.6 | 15.2 | 17.0 | 16.0 | 15.6 |
| | (std) | (2.8) | (2.6) | (3.2) | (1.0) | (4.5) | (0.8) |
| | CV % | 11 | 17 | 21 | 6 | 28 | 5 |
| | Median | 26.1 | 16.4 | 14.8 | 16.5 | 15.7 | 15.8 |
| Late $t_{50\%}$ (minutes) | N | 4 | 4 | 4 | 4 | 4 | 4 |
| | Arith. Mean | 120.0 | 85.6 | 92.8 | 85.4 | 80.4 | 77.1 |
| | (std) | (10.5) | (17.4) | (23.5) | (20.9) | (11.6) | (21.8) |
| | CV % | 9 | 20 | 25 | 25 | 14 | 28 |
| | Median | 120 | 79.8 | 88.0 | 82.2 | 83.1 | 77.2 |
| $AUC_{0-60}$ (min * pmol/L) | N | 4 | 4 | 4 | 4 | 4 | 4 |
| | Geo. Mean | 11658 | 14886 | 18299 | 19494 | 23424 | 18523 |
| | CV % | 18 | 20 | 22 | 17 | 27 | 25 |
| | Median | 11600 | 16150 | 19400 | 20050 | 22150 | 17650 |

TABLE 19e-continued

Insulin PK Parameters for 6 U Humalog ® insulin lispro with varying doses of rHuPH20

| Variable | | Amount of rHuPH20 | | | | | |
|---|---|---|---|---|---|---|---|
| (units) | Statistic | 0 μg/mL | 0.08 μg/mL | 0.31 μg/mL | 1.25 μg/mL | 5 μg/mL | 20 μg/mL |
| $AUC_{last}$ (min * pmol/L) | N | 4 | 4 | 4 | 4 | 4 | 4 |
| | Geo. Mean | 38590 | 30890 | 41165 | 39504 | 47405 | 36705 |
| | CV % | 9 | 10 | 33 | 14 | 17 | 12 |
| | Median | 39200 | 30950 | 36350 | 38150 | 4610 | 35700 |

Example 2

Generation of a Soluble rHuPH20-Expressing Cell Line

The HZ24 plasmid (set forth in SEQ ID NO:52) was used to transfect Chinese Hamster Ovary (CHO cells) (see e.g. U.S. patent application Ser. Nos. 10,795,095, 11/065,716 and 11/238,171). The HZ24 plasmid vector for expression of soluble rHuPH20 contains a pCI vector backbone (Promega), DNA encoding amino acids 1-482 of human PH20 hyaluronidase (SEQ ID NO:49), an internal ribosomal entry site (IRES) from the ECMV virus (Clontech), and the mouse dihydrofolate reductase (DHFR) gene. The pCI vector backbone also includes DNA encoding the Beta-lactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO: 1), followed by a BamHI restriction site. The construct pCI-PH20-IRES-DHFR-SV40pa (HZ24), therefore, results in a single mRNA species driven by the CMV promoter that encodes amino acids 1-482 of human PH20 (set forth in SEQ ID NO:3) and amino acids 1-186 of mouse dihydrofolate reductase (set forth in SEQ ID NO:53), separated by the internal ribosomal entry site (IRES).

Non-transfected DG44 CHO cells growing in GIBCO Modified CD-CHO media for DHFR(−) cells, supplemented with 4 mM Glutamine and 18 ml/L Pluronic F68/L (Gibco), were seeded at $0.5 \times 10^6$ cells/ml in a shaker flask in preparation for transfection. Cells were grown at 37° C. in 5% $CO_2$ in a humidified incubator, shaking at 120 rpm. Exponentially growing non-transfected DG44 CHO cells were tested for viability prior to transfection.

Sixty million viable cells of the non-transfected DG44 CHO cell culture were pelleted and resuspended to a density of $2 \times 10^7$ cells in 0.7 mL of 2x transfection buffer (2xHeBS: 40 mM HEPES, pH 7.0, 274 mM NaCl, 10 mM KCl, 1.4 mM $Na_2HPO_4$, 12 mM dextrose). To each aliquot of resuspended cells, 0.09 mL (250 μg) of the linear HZ24 plasmid (linearized by overnight digestion with Cla I (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 μF or at 350 V and 960 μF.

The cells were removed from the cuvettes after electroporation and transferred into 5 mL of Modified CD-CHO media for DHFR(−) cells, supplemented with 4 mM Glutamine and 18 ml/L Pluronic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity, using the microturbidity assay described in Example 5. Results are shown in Table 20.

TABLE 20

Initial Hyaluronidase Activity of HZ24 Transfected DG44 CHO cells at 40 hours post-transfection

| | Dilution | Activity Units/ml |
|---|---|---|
| Transfection 1 330 V | 1 to 10 | 0.25 |
| Transfection 2 350 V | 1 to 10 | 0.52 |
| Negative Control | 1 to 10 | 0.015 |

Cells from Transfection 2 (350V) were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate (Table 21).

TABLE 21

Hyaluronidase activity of identified clones

| Plate/Well ID | Relative Hyaluronidase |
|---|---|
| 1C3 | 261 |
| 2C2 | 261 |
| 3D3 | 261 |
| 3E5 | 243 |
| 3C6 | 174 |
| 2G8 | 103 |
| 1B9 | 304 |
| 2D9 | 273 |
| 4D10 | 302 |

Six HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment. Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate giving rise to clones producing in excess of 1,000 Units/ml in shaker flasks (clone 3D35M; or Gen1 3D35M). A master cell bank (MCB) of the 3D35M cells was then prepared.

Example 3

Determination of Hyaluronidase Activity of Soluble rHuPH20

Hyaluronidase activity of soluble rHuPH20 in samples such as cell cultures, purification fractions and purified solutions was determined using a turbidometric assay, which is based on the formation of an insoluble precipitate when hyaluronic acid binds with serum albumin. The activity is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30 minute development period. The decrease in turbidity resulting from enzyme activity on the sodium hyaluronate substrate is a measure of the soluble rHuPH20 hyaluronidase activity. The method is performed using a calibration curve generated with dilutions of a soluble rHuPH20 assay working reference standard, and sample activity measurements are made relative to this calibration curve.

Dilutions of the sample were prepared in Enzyme Diluent Solution. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of SWFI, and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not be less than 20 µL. The minimum sample volumes needed to perform the assay were: In-process Samples, FPLC Fractions: 80 µL; Tissue Culture Supernatants: 1 mL; Concentrated Material 80 µL; Purified or Final Step Material: 80 µL. The dilutions were made in triplicate in a Low Protein Binding 96-well plate, and 30 µL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 µL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 µL sodium hyaluronate into each well. The plate was then removed from the MULTIDROP 384 and shaken for 10 seconds before being transferred to a heat block with the plate cover replaced. The plate was incubated at 37° C. for 10 minutes The MULTIDROP 384 was prepared to stop the reaction by priming the machine with Serum Working Solution and changing the volume setting to 240 µL. (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384 and 240 µL of serum Working Solutions was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/ml) by the protein concentration (mg/mL).

Example 4

Production and Purification of Gen1 Human sPH20

A. 5 L Bioreactor Process

A vial of 3D35M was thawed and expanded from shaker flasks through 1 L spinner flasks in CD-CHO media (Invitrogen, Carlsbad Calif.) supplemented with 100 nM Methotrexate and GlutaMAX™-1 (Invitrogen). Cells were transferred from spinner flasks to a 5 L bioreactor (Braun) at an inoculation density of $4\times10^5$ viable cells per ml. Parameters were temperature Setpoint 37° C., pH 7.2 (starting Set point), with Dissolved Oxygen Set point 25% and an air overlay of 0-100 cc/min. At 168 hrs, 250 ml of Feed #1 Medium (CD CHO with 50 g/L Glucose) was added. At 216 hours, 250 ml of Feed #2 Medium (CD CHO with 50 g/L Glucose and 10 mM Sodium Butyrate) was added, and at 264 hours 250 ml of Feed #2 Medium was added. This process resulted in a final productivity of 1600 Units per ml with a maximal cell density of $6\times10^6$ cells/ml. The addition of sodium butyrate was to dramatically enhance the production of soluble rHuPH20 in the final stages of production.

Conditioned media from the 3D35M clone was clarified by depth filtration and tangential flow infiltration into 10 mM HEPES pH 7.0. Soluble rHuPH20 was then purified by sequential chromatography on Q Sparse (Pharmacia) ion exchange, Phenyl Sparse (Pharmacia) hydrophobic interaction chromatography, phenyl boronate (Prometics) and Hydroxapatite Chromatography (Biorad, Richmond, Calif.).

Soluble rHuPH20 bound to Q Sparse and eluted at 400 mM NaCl in the same buffer. The eluate was diluted with 2M ammonium sulfate to a final concentration of 500 mM ammonium sulfate and passed through a Phenyl Sparse (low sub) column, followed by binding under the same conditions to a phenyl boronate resin. The soluble rHuPH20 was eluted from the phenyl sepharose resin in HEPES pH 6.9 after washing at pH 9.0 in 50 mM bicine without ammonium sulfate. The eluate was loaded onto a ceramic hydroxyapatite resin at pH 6.9 in 5 mM potassium phosphate and 1 mM $CaCl_2$ and eluted with 80 mM potassium phosphate, pH 7.4 with 0.1 mM $CaCl_2$.

The resultant purified soluble rHuPH20 possessed a specific activity in excess of 65,000 USP Units/mg protein by way of the microturbidity assay (Example 3) using the USP reference standard. Purified sPH20 eluted as a single peak from 24 to 26 minutes from a Pharmacia 5RPC styrene divinylbenzene column with a gradient between 0.1% $TFA/H_2O$ and 0.1% TFA/90% acetonitrile/10% $H_2O$ and resolved as a single broad 61 kDa band by SDS electrophoresis that reduced to a sharp 51 kDa band upon treatment with PNGASE-F. N-terminal amino acid sequencing revealed that the leader peptide had been efficiently removed.

B. Upstream Cell Culture Expansion Process into 100 L Bioreactor Cell Culture

A scaled-up process was used to separately purify soluble rHuPH20 from four different vials of 3D35M cell to produce 4 separate batches of sHuPH20; HUA0406C, HUA0410C, HUA0415C and HUA0420C. Each vial was separately expanded and cultured through a 125 L bioreactor, then purified using column chromatography. Samples were taken throughout the process to assess such parameters as enzyme yield. The description of the process provided below sets forth representative specifications for such things as bioreactor starting and feed media volumes, transfer cell densities, and wash and elution volumes. The exact numbers vary slightly with each batch, and are detailed in Tables 24 to 30.

Four vials of 3D35M cells were thawed in a 37° C. water bath, CD CHO containing 100 nM methotrexate and 40 mL/L GlutaMAX was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached $1.5-2.5\times10^6$ cells/mL, the culture was expanded into a 125 mL spinner flask in a 100 mL culture volume. The flask was incubated at 37° C., 7% $CO_2$. When the cell density reached $1.5-2.5\times10^6$ cells/mL, the culture was expanded into a 250 mL spinner flask in 200 mL culture volume, and the flask was incubated at 37° C., 7% $CO_2$. When the cell density reached $1.5-2.5\times10^6$ cells/mL, the culture was expanded into a 1 L spinner flask in 800 mL culture volume and incubated at 37° C., 7% $CO_2$. When the cell density reached $1.5-2.5\times10^6$ cells/mL, the culture was expanded into a 6 L spinner flask in 5 L culture volume and incubated at 37° C., 7% $CO_2$. When the cell density reached $1.5-2.5\times10^6$ cells/mL, the culture was expanded into a 36 L spinner flask in 20 L culture volume and incubated at 37° C., 7% $CO_2$.

A 125 L reactor was sterilized with steam at 121° C., 20 PSI and 65 L of CD CHO media was added. Before use, the reactor was checked for contamination. When the cell density in the 36 L spinner flasks reached $1.8-2.5\times10^6$ cells/mL, 20 L cell culture were transferred from the 36 L spinner flasks to the 125 L bioreactor (Braun), resulting a final volume of 85 L and a seeding density of approximately $4\times10^5$ cells/mL. Parameters were temperature setpoint, 37° C.; pH: 7.2; Dissolved oxygen: 25%±10%; Impeller Speed 50 rpm; Vessel Pressure 3 psi; Air Sparge 1 L/min.; Air Overlay: 1 L/min. The reactor was sampled daily for cell counts, pH verification, media analysis, protein production and retention. Nutrient feeds were added during the run. At Day 6, 3.4 L of Feed #1 Medium (CD CHO+50 g/L Glucose+40 mL/L GlutaMAX™-1) was added, and culture temperature was changed to 36.5° C. At day 9, 3.5 L of Feed #2 (CD CHO+50 g/L Glucose+40 mL/L GlutaMAX™-1+1.1 g/L Sodium Butyrate) was added, and culture temperature was changed to 36° C. At day 11, 3.7 L of Feed #3 (CD CHO+50 g/L Glucose+40 mL/L GlutaMAX™-1+1.1 g/L Sodium Butyrate) was added, and the culture temperature was changed to 35.5° C. The reactor was harvested at 14 days or when the viability of the cells dropped below 50%. The process resulted in production of soluble rHuPH20 with an enzymatic activity of 1600 Units/ml with a maximal cell density of 8 million cells/mL. At harvest, the culture was sampled for mycoplasma, bioburden, endotoxin, and virus in vitro and in vivo, transmission electron microscopy (TEM) for viral particles, and enzyme activity.

The one hundred liter bioreactor cell culture harvest was filtered through a series of disposable capsule filters having a polyethersulfone medium (Sartorius): first through a 8.0 μm depth capsule, a 0.65 μm depth capsule, a 0.22 μm capsule, and finally through a 0.22 μm Sartopore 2000 $cm^2$ filter and into a 100 L sterile storage bag. The culture was concentrated 10× using two TFF with Spiral Polyethersulfone 30 kDa MWCO filters (Millipore), followed by a 6× buffer exchange with 10 mM HEPES, 25 mM $Na_2SO_4$, pH 7.0 into a 0.22 μm final filter into a 20 L sterile storage bag. Table 22 provides monitoring data related to the cell culture, harvest, concentration and buffer exchange steps.

TABLE 22

Monitoring data for cell culture, harvest, concentration and buffer exchange steps.

| Parameter | HUA0406C | HUA04010C | HUA0415C | HUA0420C |
|---|---|---|---|---|
| Time from thaw to inoculate 100 L bioreactor (days) | 21 | 19 | 17 | 18 |
| 100 L inoculation density ($\times10^6$ cells/mL) | 0.45 | 0.33 | 0.44 | 0.46 |
| Doubling time in logarithmic growth (hr) | 29.8 | 27.3 | 29.2 | 23.5 |
| Max. cell density ($\times10^6$ cells/mL) | 5.65 | 8.70 | 6.07 | 9.70 |
| Harvest viability (%) | 41 | 48 | 41 | 41 |
| Harvest titer (U/ml) | 1964 | 1670 | 991 | 1319 |
| Time in 100-L bioreactor (days) | 13 | 13 | 12 | 13 |
| Clarified harvest volume (mL) | 81800 | 93300 | 91800 | 89100 |
| Clarified harvest enzyme assay (U/mL) | 2385 | 1768 | 1039 | 1425 |

TABLE 22-continued

Monitoring data for cell culture, harvest, concentration and buffer exchange steps.

| Parameter | HUA0406C | HUA04010C | HUA0415C | HUA0420C |
|---|---|---|---|---|
| Concentrate enzyme assay (U/mL) | 22954 | 17091 | 8561 | 17785 |
| Buffer exchanged concentrate enzyme assay (U/mL) | 15829 | 11649 | 9915 | 8679 |
| Filtered buffer exchanged concentrate enzyme assay (U/mL) | 21550 | 10882 | 9471 | 8527 |
| Buffer exchanged concentrate volume(mL) | 10699 | 13578 | 12727 | 20500 |
| Ratio enzyme units concentration/harvest | 0.87 | 0.96 | 1.32 | 1.4 |

A Q Sparse (Pharmacia) ion exchange column (3 L resin, Height=20 cm, Diameter=14 cm) was prepared. Wash samples were collected for a determination of pH, conductivity and endotoxin (LAL) assay. The column was equilibrated with 5 column volumes of 10 mM Tris, 20 mM $Na_2SO_4$, pH 7.5. The concentrated, diafiltered harvest was loaded onto the Q column at a flow rate of 100 cm/hr. The column was washed with 5 column volumes of 10 mM Tris, 20 mM $Na_2SO_4$, pH 7.5 and 10 mM HEPES, 50 mM NaCl, pH 7.0. The protein was eluted with 10 mM HEPES, 400 mM NaCl, pH 7.0 and filtered through a 0.22 μm final filter into a sterile bag.

Phenyl-Sparse (Pharmacia) hydrophobic interaction chromatography was next performed. A Phenyl-Sparse (PS) column (9.1 L resin, Height=29 cm, Diameter=20 cm) was prepared. The column was equilibrated with 5 column volumes of 5 mM potassium phosphate, 0.5 M ammonium sulfate, 0.1 mM $CaCl_2$, pH 7.0. The protein eluate from above was supplemented with 2M ammonium sulfate, 1 M potassium phosphate and 1 M $CaCl_2$ stock solutions to final concentrations of 5 mM, 0.5 M and 0.1 mM, respectively. The protein was loaded onto the PS column at a flow rate of 100 cm/hr. 5 mM potassium phosphate, 0.5 M ammonium sulfate and 0.1 mM $CaCl_2$ pH 7.0 was added at 100 cm/hr. The flow through was passed through a 0.22 μm final filter into a sterile bag.

The PS-purified protein was the loaded onto an aminophenyl boronate column (ProMedics) (6.3 L resin, Height=20 cm, Diameter=20 cm) that had been equilibrated with 5 column volumes of 5 mM potassium phosphate, 0.5 M ammonium sulfate. The protein was passed through the column at a flow rate of 100 cm/hr, and the column was washed with 5 mM potassium phosphate, 0.5 M ammonium sulfate, pH 7.0. The column was then washed with 20 mM bicine, 100 mM NaCl, pH 9.0 and the protein eluted with 50 mM HEPES, 100 mM NaCl pH 6.9 through a sterile filter and into a 20 L sterile bag. The eluate was tested for bioburden, protein concentration and enzyme activity.

A hydroxyapatite (HAP) column (BioRad) (1.6 L resin, Height=10 cm, Diameter=14 cm) was equilibrated with 5 mM potassium phosphate, 100 mM NaCl, 0.1 mM $CaCl_2$ pH 7.0. Wash samples were collected and tested for pH, conductivity and endotoxin (LAL assay. The aminophenyl boronate purified protein was supplemented with potassium phosphate and $CaCl_2$ to yield final concentrations of 5 mM potassium phosphate and 0.1 mM $CaCl_2$ and loaded onto the HAP column at a flow rate of 100 cm/hr. The column was washed with 5 mM potassium phosphate pH 7.0, 100 mM NaCl, 0.1 mM $CaCl_2$, then 10 mM potassium phosphate pH 7.0, 100 mM NaCl, 0.1 mM $CaCl_2$ pH. The protein was eluted with 70 mM potassium phosphate pH 7.0 and filtered through a 0.22 μm filter into a 5 L sterile storage bag. The eluate was tested for bioburden, protein concentration and enzyme activity.

The HAP-purified protein was then pumped through a 20 nM viral removal filter via a pressure tank. The protein was added to the DV20 pressure tank and filter (Pall Corporation), passing through an Ultipor DV20 Filter with 20 nm pores (Pall Corporation) into a sterile 20 L storage bag. The filtrate was tested for protein concentration, enzyme activity, oligosaccharide, monosaccharide and sialic acid profiling, and process-related impurities. The protein in the filtrate was then concentrated to 1 mg/mL using a 10 kD molecular weight cut off (MWCO) Sartocon Slice tangential flow filtration (TFF) system (Sartorius). The filter was first prepared by washing with a HEPES/saline solution (10 mM HEPES, 130 mM NaCl, pH 7.0) and the permeate was sampled for pH and conductivity. Following concentration, the concentrated protein was sampled and tested for protein concentration and enzyme activity. A 6× buffer exchange was performed on the concentrated protein into the final buffer: 10 mM HEPES, 130 mM NaCl, pH 7.0. The concentrated protein was passed though a 0.22 μm filter into a 20 L sterile storage bag. The protein was sampled and tested for protein concentration, enzyme activity, free sulfhydryl groups, oligosaccharide profiling and osmolarity.

Tables 23 to 29 provide monitoring data related to each of the purification steps described above, for each 3D35M cell lot.

TABLE 23

Q sepharose column data

| Parameter | HUA0406C | HUA0410C | HUA0415C | HUA0420C |
|---|---|---|---|---|
| Load volume (mL) | 10647 | 13524 | 12852 | 20418 |
| Load Volume/ Resin Volume ratio | 3.1 | 4.9 | 4.5 | 7.3 |
| Column Volume (mL) | 2770 | 3840 | 2850 | 2880 |
| Eluate volume (mL) | 6108 | 5923 | 5759 | 6284 |
| Protein Conc. of Eluate (mg/mL) | 2.8 | 3.05 | 2.80 | 2.86 |
| Eluate Enzyme Assay (U/mL) | 24493 | 26683 | 18321 | 21052 |
| Enzyme Yield (%) | 65 | 107 | 87 | 76 |

TABLE 24

Phenyl Sepharose column data

| Parameter | HUA0406C | HUA0410C | HUA0415C | HUA0420C |
|---|---|---|---|---|
| Volume Before Stock Solution Addition (mL) | 5670 | 5015 | 5694 | 6251 |
| Load Volume (mL) | 7599 | 6693 | 7631 | 8360 |
| Column Volume (mL) | 9106 | 9420 | 9340 | 9420 |
| Load Volume/ Resin Volume ratio | 0.8 | 0.71 | 0.82 | 0.89 |
| Eluate volume (mL) | 16144 | 18010 | 16960 | 17328 |
| Protein Conc of Eluate (mg/mL) | 0.4 | 0.33 | 0.33 | 0.38 |
| Eluate Enzyme Assay (U/mL) | 8806 | 6585 | 4472 | 7509 |
| Protein Yield (%) | 41 | 40 | 36 | 37 |
| Enzyme Yield (%) | 102 | 88 | 82 | 96 |

TABLE 25

Amino Phenyl Boronate column data

| Parameter | HUA0406C | HUA0410C | HUA0415C | HUA0420C |
|---|---|---|---|---|
| Load Volume (mL) | 16136 | 17958 | 16931 | 17884 |
| Load Volume/ Resin Volume ratio | 2.99 | 3.15 | 3.08 | 2.98 |
| Column Volume (mL) | 5400 | 5700 | 5500 | 5300 |
| Eluate volume (mL) | 17595 | 22084 | 20686 | 19145 |
| Protein Conc. of Eluate (mg/mL) | 0.0 | 0.03 | 0.03 | 0.04 |
| Protein Conc. of Filtered Eluate (mg/mL) | not tested | 0.03 | 0.00 | 0.04 |
| Eluate Enzyme Assay (U/mL) | 4050 | 2410 | 1523 | 4721 |
| Protein Yield (%) | 0 | 11 | 11 | 12 |
| Enzyme Yield (%) | not determined | 41 | 40 | 69 |

TABLE 26

Hydroxyapatite column data

| Parameter | HUA0406C | HUA0410C | HUA0415C | HUA0420C |
|---|---|---|---|---|
| Volume Before Stock Solution Addition (mL) | 16345 | 20799 | 20640 | 19103 |
| Load Volume/ Resin Volume ratio | 10.95 | 13.58 | 14.19 | 12.81 |
| Column Volume (mL) | 1500 | 1540 | 1462 | 1500 |
| Load volume (mL) | 16429 | 20917 | 20746 | 19213 |
| Eluate volume (mL) | 4100 | 2415 | 1936 | 2419 |
| Protein Conc. of Eluate (mg/mL) | not tested | 0.24 | 0.17 | 0.23 |
| Protein Conc. of Filtered Eluate (mg/mL) | NA | NA | 0.17 | NA |
| Eluate Enzyme Assay (U/mL) | 14051 | 29089 | 20424 | 29826 |
| Protein Yield (%) | Not tested | 93 | 53 | 73 |
| Enzyme Yield (%) | 87 | 118 | 140 | 104 |

TABLE 27

DV20 filtration data

| Parameter | HUA0406C | HUA0410C | HUA0415C | HUA0420C |
|---|---|---|---|---|
| Start volume (mL) | 4077 | 2233 | 1917 | 2419 |
| Filtrate Volume (mL) | 4602 | 3334 | 2963 | 3504 |
| Protein Conc. of Filtrate (mg/mL) | 0.1 | NA | 0.09 | NA |
| Protein Conc. of Filtered Eluate (mg/mL) | NA | 0.15 | 0.09 | 0.16 |
| Protein Yield (%) | not tested | 93 | 82 | 101 |

TABLE 28

Final concentration data

| Parameter | HUA0406C | HUA0410C | HUA0415C | HUA0420C |
|---|---|---|---|---|
| Start volume (mL) | 4575 | 3298 | 2963 | 3492 |
| Concentrate Volume (mL) | 562 | 407 | 237 | 316 |
| Protein Conc. of Concentrate (mg/mL) | 0.9 | 1.24 | 1.16 | 1.73 |
| Protein Yield (%) | 111 | 102 | 103 | 98 |

TABLE 29

Buffer Exchange into Final Formulation data

| Parameter | HUA0406C | HUA0410C | HUA0415C | HUA0420C |
|---|---|---|---|---|
| Start Volume (mL) | 562 | 407 | 237 | 316 |
| Final Volume Buffer Exchanged Concentrate (mL) | 594 | 516 | 310 | 554 |
| Protein Conc. of Concentrate (mg/mL) | 1.00 | 0.97 | 0.98 | 1.00 |

TABLE 29-continued

Buffer Exchange into Final Formulation data

| Parameter | HUA0406C | HUA0410C | HUA0415C | HUA0420C |
|---|---|---|---|---|
| Protein Conc. of Filtered Concentrate (mg/mL) | 0.95 | 0.92 | 0.95 | 1.02 |
| Protein Yield (%) | 118 | 99 | 110 | 101 |

The purified and concentrated soluble rHuPH20 protein was aseptically filled into sterile vials with 5 mL and 1 mL fill volumes. The protein was passed though a 0.22 µm filter to an operator controlled pump that was used to fill the vials using a gravimetric readout. The vials were closed with stoppers and secured with crimped caps. The closed vials were visually inspected for foreign particles and then labeled. Following labeling, the vials were flash-frozen by submersion in liquid nitrogen for no longer than 1 minute and stored at ≦−15° C. (−20±5° C.).

Example 5

Production Gen2 Cells Containing Soluble Human PH20 (rHuPH20)

The Gen1 3D35M cell line described in Example 2 was adapted to higher methotrexate levels to produce generation 2 (Gen2) clones. 3D35M cells were seeded from established methotrexate-containing cultures into CD CHO medium containing 4 mM GlutaMAX-1™ and 1.0 µM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 µM methotrexate. After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the $12^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the $8^{th}$ passage in medium containing 20.0 µM methotrexate were cloned out by limiting dilution in 96-well tissue culture plates containing CD CHO medium containing 4 mM GlutaMAX-1™ and 20.0 µM methotrexate. Clones were identified 5-6 weeks later and clone 2B2 was selected for expansion in medium containing 20.0 µM methotrexate. After the 11th passage, 2B2 cells were frozen in vials as a research cell bank (RCB).

The resultant 2B2 cells are dihydrofolate reductase deficient (dhfr-) DG44 CHO cells that express soluble recombinant human PH20 (rHuPH20). The soluble PH20 is present in 2B2 cells at a copy number of approximately 206 copies/cell. Southern blot analysis of Spe I—, Xba I— and BamH I/Hind III-digested genomic 2B2 cell DNA using a rHuPH20-specific probe revealed the following restriction digest profile: one major hybridizing band of ~7.7 kb and four minor hybridizing bands (~13.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III. Sequence analysis of the mRNA transcript indicated that the derived cDNA (SEQ ID NO:56) was identical to the reference sequence (SEQ ID NO:49) except for one base pair difference at position 1131, which was observed to be a thymidine (T) instead of the expected cytosine (C). This is a silent mutation, with no effect on the amino acid sequence.

Example 6

A. Production of Gen2 soluble rHuPH20 in 300 L Bioreactor Cell Culture

A vial of HZ24-2B2 was thawed and expanded from shaker flasks through 36 L spinner flasks in CD-CHO media (Invitrogen, Carlsbad, Calif.) supplemented with 20 µM methotrexate and GlutaMAX-1™ (Invitrogen). Briefly, the vial of cells was thawed in a 37° C. water bath, media was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5 \times 10^6$ cells/mL, the culture was expanded into a 250 mL spinner flask in 200 mL culture volume, and the flask was incubated at 37° C., 7% $CO_2$. When the cell density reached greater than $1.5 \times 10^6$ cells/mL, the culture was expanded into a 1 L spinner flask in 800 mL culture volume and incubated at 37° C., 7% $CO_2$. When the cell density reached greater than $1.5 \times 10^6$ cells/mL the culture was expanded into a 6 L spinner flask in 5000 mL culture volume and incubated at 37° C., 7% $CO_2$. When the cell density reached greater than $1.5 \times 10^6$ cells/mL the culture was expanded into a 36 L spinner flask in 32 L culture volume and incubated at 37° C., 7% $CO_2$.

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of $4.0 \times 10^5$ viable cells per ml and a total volume of 260 L. Parameters were temperature setpoint, 37° C.; Impeller Speed 40-55 RPM; Vessel Pressure: 3 psi; Air Sparge 0.5-1.5 L/min.; Air Overlay: 3 L/min. The reactor was sampled daily for cell counts, pH verification, media analysis, protein production and retention. Also, during the run nutrient feeds were added. At 120 hrs (day 5), 10.4L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (1×CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (1×CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for mycoplasma, bioburden, endotoxin and viral in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 µm and a layer of diatomaceous earth graded to 1.4-1.1 µm, followed by a cellulose membrane, then through a second single Millistak filtration system (Millipore) containing a layer of diatomaceous earth graded to 0.4-0.11 µm and a layer of diatomaceous earth graded to <0.1 µm, followed by a cellulose membrane, and then through a 0.22 µm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filter (Sartorious), followed by a 10× buffer exchange with 10 mM Tris, 20 mM $Na_2SO_4$, pH 7.5 into a 0.22 µm final filter into a 50 L sterile storage bag.

The concentrated, diafiltered harvest was inactivated for virus. Prior to viral inactivation, a solution of 10% Triton X-100, 3% tri (n-butyl) phosphate (TNBP) was prepared. The concentrated, diafiltered harvest was exposed to 1% Triton X-100, 0.3% TNBP for 1 hour in a 36 L glass reaction vessel immediately prior to purification on the Q column.

B. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM $Na_2SO_4$, pH 7.5. Following viral inactivation, the concentrated, diafiltered harvest was loaded onto the Q column at a flow rate of 100 cm/hr. The column was washed with 5 column volumes of 10 mM Tris, 20 mM $Na_2SO_4$, pH 7.5 and 10 mM HEPES, 50 mM NaCl, pH 7.0. The protein was eluted with 10 mM HEPES, 400 mM NaCl, pH 7.0 into a 0.22 µm final filter into sterile bag. The eluate sample was tested for bioburden, protein concentration and hyaluronidase activity. $A_{280}$ absorbance reading were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM $CaCl_2$, pH 7.0. The protein eluate from the Q sepharose column was supplemented with 2M ammonium sulfate, 1 M potassium phosphate and 1 M $CaCl_2$ stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM $CaCl_2$ pH 7.0 at 100 cm/hr and the wash was added to the collected flow thru. Combined with the column wash, the flow through was passed through a 0.22 µm final filter into a sterile bag. The flow through was sampled for bioburden, protein concentration and enzyme activity.

An aminophenyl boronate column (Prometics) was prepared. The wash was collected and sampled for pH, conductivity and endotoxin (LAL assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM HEPES, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and tested for pH, conductivity and endotoxin (LAL assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM $CaCl_2$. The protein was eluted with 70 mM potassium phosphate, pH 7.0 and passed through a 0.22 µm sterile filter into a sterile bag. The eluted sample was tested for bioburden, protein concentration and enzyme activity.

The HAP purified protein was then passed through a viral removal filter. The sterilized Virosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 µm final filter into a sterile bag. The viral filtered sample was tested for protein concentration, enzyme activity, oligosaccharide, monosaccharide and sialic acid profiling. The sample also was tested for process related impurities.

The protein in the filtrate was then concentrated to 10 mg/mL using a 10 kD molecular weight cut off (MWCO) Sartocon Slice tangential flow filtration (TFF) system (Sartorius). The filter was first prepared by washing with 10 mM histidine, 130 mM NaCl, pH 6.0 and the permeate was sampled for pH and conductivity. Following concentration, the concentrated protein was sampled and tested for protein concentration and enzyme activity. A 6× buffer exchange was performed on the concentrated protein into the final buffer: 10 mM histidine, 130 mM NaCl, pH 6.0. Following buffer exchange, the concentrated protein was passed though a 0.22 µm filter into a 20 L sterile storage bag. The protein was sampled and tested for protein concentration, enzyme activity, free sulfhydryl groups, oligosaccharide profiling and osmolarity.

The sterile filtered bulk protein was then aseptically dispensed at 20 mL into 30 mL sterile Teflon vials (Nalgene). The vials were then flash frozen and stored at −20±5° C.

C. Comparison of Production and Purification of Gen1 Soluble rHuPH20 and Gen2 Soluble rHuPH20

The production and purification of Gen2 soluble rHuPH20 in a 300 L bioreactor cell culture contained some changes in the protocols compared to the production and purification Gen1 soluble rHuPH20 in a 100 L bioreactor cell culture (described in Example 4B). Table 30 sets forth exemplary differences, in addition to simple scale up changes, between the methods.

TABLE 30

| Process Difference | Gen1 soluble rHuPH20 | Gen2 soluble rHuPH20 |
|---|---|---|
| Cell line | 3D35M | 2B2 |
| Media used to expand cell inoculum | Contains 0.10 μM methotrexate (0.045 mg/L) | Contains 20 μM methotrexate (9 mg/L) |
| Media in 6 L cultures onwards | Contains 0.10 μM methotrexate | Contains no methotrexate |
| 36 L spinner flask | No instrumentation 20 L operating volume. | Equipped with instrumentation that monitors and controls pH, dissolved oxygen, sparge and overlay gas flow rate. 32 L operating volume |
| Final operating volume in bioreactor | Approx. 100 L in a 125 L bioreactor (initial culture volume + 65 L) | Approx. 300 L in a 400 L bioreactor (initial culture volume + 260 L) |
| Culture media in final bioreactor | No rHuInsulin | 5.0 mg/L rHuInsulin |
| Media feed volume | Scaled at 4% of the bioreactor cell culture volume i.e. 3.4, 3.5 and 3.7 L, resulting in a target bioreactor volume of ~92 L. | Scaled at 4% of the bioreactor cell culture volume i.e. 10.4, 10.8, 11.2 and 11.7 L, resulting in a target bioreactor volume of ~303 L. |
| Media feed | Feed #1 Medium: CD CHO + 50 g/L Glucose + 8 mM GlutaMAX ™-1 Feed #2 (CD CHO + 50 g/L Glucose + 8 mM GlutaMAX + 1.1 g/L Sodium Butyrate Feed #3: CD CHO + 50 g/L Glucose + 8 mM GlutaMAX + 1.1 g/L Sodium Butyrate | Feed #1 Medium: 4x CD CHO + 33 g/L Glucose + 32 mM Glutamax + 16.6 g/L Yeastolate + 33 mg/L rHuInsulin Feed #2: 2x CD CHO + 33 g/L Glucose + 16 mM Glutamax + 33.4 g/L Yeastolate + 0.92 g/L Sodium Butyrate Feed #3: 1x CD CHO + 50 g/L Glucose + 10 mM Glutamax + 50 g/L Yeastolate + 1.80 g/L Sodium Butyrate Feed #4: 1x CD CHO + 33 g/L Glucose + 6.6 mM Glutamax + 50 g/L Yeastolate + 0.92 g/L Sodium Butyrate |
| Filtration of bioreactor cell culture | Four polyethersulfone filters (8.0 μm, 0.65 μm, 0.22 μm and 0.22 μm) in series 100 L storage bag | $1^{st}$ stage - Four modules in parallel, each with a layer of diatomaceous earth graded to 4-8 μm and a layer of diatomaceous earth graded to 1.4-1.1 μm, followed by a cellulose membrane. $2^{nd}$ stage - single module containing a layer of diatomaceous earth graded to 0.4-0.11 μm and a layer of diatomaceous earth graded to <0.1 μm, followed by a cellulose membrane. $3^{rd}$ stage - 0.22 μm polyethersulfone filter 300 L storage bag Harvested cell culture is supplemented with 10 mM EDTA, 10 mM Tris to a pH of 7.5. |
| Concentration and buffer exchange prior to chromatography | Concentrate with 2 TFF with Millipore Spiral Polyethersulfone 30K MWCO Filter Buffer Exchange the Concentrate 6x with 10 mM HEPES, 25 mM NaCl, pH 7.0 20 L sterile storage bag | Concentrate using four Sartorius Sartoslice TFF 30K MWCO Filter Buffer Exchange the Concentrate 10x with 10 mM Tris, 20 mM Na2SO4, pH 7.5 50 L sterile storage bag |

TABLE 30-continued

| Process Difference | Gen1 soluble rHuPH20 | Gen2 soluble rHuPH20 |
|---|---|---|
| Viral inactivation prior to chromatography | None | Viral inactivation performed with the addition of a 1% Triton X-100, 0.3% Tributyl Phosphate, pH 7.5, |
| 1st purification step (Q sepharose) | No absorbance reading | A280 measurements at the beginning and end |
| Viral filtration after chromatography | Pall DV-20 filter (20 nm) | Sartorius Virosart filter (20 nm) |
| Concentration and buffer exchange after chromatography | HEPES/saline pH 7.0 buffer Protein concentrated to 1 mg/ml | Histidine/saline, pH 6.0 buffer Protein concentrated to 10 mg/ml |

Example 7

Determination of Sialic Acid and Monosaccharide Content

The sialic acid and monosaccharide content of soluble rHuPH20 can be assessed by reverse phase liquid chromatography (RPLC) following hydrolysis with trifluoroacetic acid. In one example, the sialic acid and monosaccharide content of purified hyaluronidase lot # HUB0701E (1.2 mg/mL; produced and purified essentially as described in Example 6) was determined. Briefly, 100 μg sample was hydrolyzed with 40% (v/v) trifluoroacetic acid at 100° C. for 4 hours in duplicate. Following hydrolysis, the samples were dried down and resuspended in 300 μL water. A 45 μL aliquot from each re-suspended sample was transferred to a new tube and dried down, and 10 μL of a 10 mg/mL sodium acetate solution was added to each. The released monosaccharides were fluorescently labeled by the addition of 50 μL of a solution containing 30 mg/mL 2-aminobenzoic acid, 20 mg/mL sodium cyanoborohydride, approximately 40 mg/mL sodium acetate and 20 mg/mL boric acid in methanol. The mixture was incubated for 30 minutes at 80° C. in the dark. The derivitization reaction was quenched by the addition of 440 μL of mobile phase A (0.2% (v/v) n-butylamine, 0.5% (v/v) phosphoric acid, 1% (v/v) tetrahydrofuran). A matrix blank of water also was hydrolyzed and derivitized as described for the hyaluronidase sample as a negative control. The released monosaccharides were separated by RPLC using an Octadecyl ($C_{18}$) reverse phase column (4.6×250 mm, 5 μm particle size; J. T. Baker) and monitored by fluorescence detection (360 nm excitation, 425 nm emission). Quantitation of the monosaccharide content was made by comparison of the chromatograms from the hyaluronidase sample with chromatograms of monosaccharide standards including N-D-glucosamine (GlcN), N-D-galactosamine (GalN), galactose, fucose and mannose. Table 31 presents the molar ratio of each monosaccharide per hyaluronidase molecule.

TABLE 31

Monosaccharide content of soluble rHuPH20

| Lot | Replicate | GlcN | GalN | Galactose | Mannose | Fucose |
|---|---|---|---|---|---|---|
| HUB0701E | 1 | 14.28 | 0.07* | 6.19 | 25.28 | 2.69 |
|  | 2 | 13.66 | 0.08* | 6.00 | 24.34 | 2.61 |
|  | Average | 13.97 | 0.08* | 6.10 | 24.81 | 2.65 |

*GalN results were below the limit of detection

Example 8

C-Terminal Heterogeneity of Soluble rHuPH20 from 3D35M and 2B2 Cells

C-terminal sequencing was performed on two lots of sHuPH20 produced and purified from 3D35M cells in a 100 L bioreactor volume (Lot HUA0505MA) and 2B2 cells in a 300 L bioreactor volume (Lot HUB0701EB). The lots were separately digested with endoproteinase Asp-N, which specifically cleaves peptide bonds N-terminally at aspartic and cysteic acid. This releases the C-terminal portion of the soluble rHuPH20 at the aspartic acid at position 431 of SEQ ID NO:4. The C-terminal fragments were separated and characterized to determine the sequence and abundance of each population in Lot HUA0505MA and Lot HUB0701EB.

It was observed that the soluble rHuPH20 preparations from 3D35M cells and 2B2 cells displayed heterogeneity, and contained polypeptides that differed from one another in their C-terminal sequence (Tables 27 and 28). This heterogeneity is likely the result of C-terminal cleavage of the expressed 447 amino acid polypeptide (SEQ ID NO:4) by peptidases present in the cell culture medium or other solutions during the production and purification process. The polypeptides in the soluble rHuPH20 preparations have amino acid sequences corresponding to amino acids 1-447, 1-446, 1-445, 1-444 and 1-443 of the soluble rHuPH20 sequence set forth SEQ ID NO:4. The full amino acid sequence of each of these polypeptides is forth in SEQ ID NOS: 4 to 8, respectively. As noted in tables 32 and 33, the abundance of each polypeptide in the soluble rHuPH20 preparations from 3D35M cells and 2B2 cells differs.

TABLE 32

Analysis of C-terminal fragments from Lot HUA0505MA

| Fragment | Amino acid position (relative to SEQ ID NO: 4) | Sequence | Theor. mass | Exp. Mass | Error | Elution time | Abundance |
|---|---|---|---|---|---|---|---|
| D28a | 431-447 | DAFKLPPMETEEPQIFY (SEQ ID NO: 57) | 2053.97 | 2054.42 | 0.45 | 99.87 | 0.2% |
| D28b | 431-446 | DAFKLPPMETEEPQIF (SEQ ID NO: 58) | 1890.91 | 1891.28 | 0.37 | 97.02 | 18.4% |
| D28c | 431-445 | DAFKLPPMETEEPQI (SEQ ID NO: 59) | 1743.84 | 1744.17 | 0.33 | 86.4 | 11.8% |
| D28d | 431-444 | DAFKLPPMETEEPQ (SEQ ID NO: 60) | 1630.70 | 1631.07 | 0.32 | 74.15 | 56.1% |
| D28e | 431-443 | DAFKLPPMETEEP (SEQ ID NO: 61) | 1502.70 | 1502.98 | 0.28 | 77.36 | 13.6% |
| D28f | 431-442 | DAFKLPPMETEE (SEQ ID NO: 62) | 1405.64 | ND | N/A | N/A | 0.0% |

TABLE 33

Analysis of C-terminal fragments from Lot HUB0701EB

| Fragment | Amino acid position (relative to SEQ ID NO: 4 | Sequence | Theor. mass | Exp. Mass | Error | Elution time | Abundance |
|---|---|---|---|---|---|---|---|
| D28a | 431-477 | DAFKLPPMETEEPQIFY (SEQ ID NO: 57) | 2053.97 | 2054.42 | 0.45 | 99.89 | 1.9% |
| D28b | 431-446 | DAFKLPPMETEEPQIF (SEQ ID NO: 58) | 1890.91 | 1891.36 | 0.45 | 96.92 | 46.7% |
| D28c | 431-445 | DAFKLPPMETEEPQI (SEQ ID NO: 59) | 1743.84 | 1744.24 | 0.40 | 85.98 | 16.7% |
| D28d | 431-444 | DAFKLPPMETEEPQ (SEQ ID NO: 60) | 1630.70 | 1631.14 | 0.39 | 73.9 | 27.8% |
| D28e | 431-443 | DAFKLPPMETEEP (SEQ ID NO: 61) | 1502.70 | 1503.03 | 0.33 | 77.02 | 6.9% |
| D28f | 431-442 | DAFKLPPMETEE (SEQ ID NO: 62) | 1405.64 | ND | N/A | N/A | 0.0% |

Example 9

Comparison of the Dispersion Activity of Different Hyaluronan Degrading Enzymes

The ability of different hyaluronan degrading enzymes to act as a dispersion agent was assessed in vivo. A dispersion assay in mice was used to assess the ability of different hyaluronan degrading enzyme to act as dispersion agents of trypan blue, and also to assess the ability of the enzymes to enhance the efficacy of co-administered insulin in reducing blood glucose levels. The hyaluronan degrading enzymes assayed included rHuPH20, pegylated PH20 (PEG PH20), Hyal 1, Chondroitinase ABC, Chondroitinase AC and *Streptomyces hyalurolyticus* lyase. These were mixed with trypan blue and Humulin® insulin in a neutral buffer (10 mM sodium phosphate, pH 7.4, 145.5 mM NaCl, 1 mg/ml human serum albumin) and delivered to anesthetized mice. Both the area of dispersion of the trypan blue and the blood glucose levels were then measured. The neutral pH buffer alone and Humulin® insulin alone were used a negative controls. The ability of a low pH buffer (pH 4.5) to act as a dispersion agent also was examined.

Nine groups of NCr nu/nu homozygous mice, approximately 10 weeks of age and with body weights of 21-25 g, with 3 mice per group, were anesthetized by intraperitoneal injection of ketamine/xylazine (10:1 mixture in saline). Thereafter, the mice were administered 40 µL of a hyaluronan degrading enzyme and 5 Units/mL Humulin® insulin with 0.4% Trypan Blue dye by intradermal injection at the midline over the caudal end of the ribcage. Control groups administered Humulin® insulin alone, buffer alone or buffer and Humulin® insulin also were included. Specifically, group 1 mice were the negative control and received trypan blue with a neutral pH buffer; group 2 mice received trypan blue with 5 Units/mL Humulin® insulin in a low pH buffer; group 3 mice received trypan blue with 5 Units/mL Humulin® insulin and 10 Units/mL rHuPH20; group 4 mice received trypan blue with 5 Units/mL Humulin® insulin and 10 Units/mL PEG PH20 (generated as described in Example 10, below); group 5 mice received trypan blue with 5 Units/mL Humulin® insulin and 10 Units/mL Hyal 1; group 6 mice received trypan blue with 5 Units/mL Humulin® insulin and 10 Units/mL Chondroitinase ABC (Associates of Cape Cod, E. Falmouth, Mass.); group 7 mice received trypan blue with 5 Units/mL Humulin® insulin and 1 Unit/mL Condroitinase AC (Associates of Cape Cod, E. Falmouth, Mass.); group 8 mice received trypan blue with 5 Units/mL Humulin® insulin and 100 Units/mL *Streptomyces hyalurolyticus* lyase (Calbiochem); group 9 mice received trypan blue with 5 Units/mL Humulin® insulin. The dispersion of the trypan blue dye was then measured by a caliper at 2.5, 5, 10, 15 and 20 minutes post injection. The dye dispersion area ($mm^2$) was calculated by multiplying the longest axis M1 (length of the dye front) and M2 (width of the dye front) by ¼π (M1M2×¼π). The blood glucose levels were measured using a glucometer at 0, 5, 10, 15 and 20 minutes 1. Dye Dispersion Table 34 sets forth the mean dye dispersion area following administration of each of the test articles. The trypan blue dye in neutral pH buffer and low pH buffer exhibit minimal spreading, with the dispersion area ranging from an average of about 36 $mm^2$ at 2.5 minutes post injection to about 51 $mm^2$ at 20 minutes post injection. When the trypan blue dye was mixed and delivered with Humulin® insulin, Hyal 1, or PEG PH20, there was no statistically significant increase in the dispersion area compared to that observed when the dye was mixed with buffer only. In contrast, a significant increase in the dispersion of the dye was observed when mixed and delivered with rHuPH20, Chondroitinase ABC, Chondroitinase AC or *Streptomyces* hyalurolyticus lyase. The average dispersion area of trypan blue dye when mixed and delivered with rHuPH20 was about 45 $mm^2$, 66 $mm^2$, 80 $mm^2$, 86 $mm^2$ and 102 $mm^2$ at 2.5, 5, 10, 15 and 20 minutes after injection, respectively. The average dispersion area of trypan blue dye when mixed and delivered with Condroitinase AC was about 76 $mm^2$, 107 $mm^2$, 107 $mm^2$, 110 $mm^2$ and 116 $mm^2$ at 2.5, 5, 10, 15 and 20 minutes after injection, respectively. The average dispersion area of trypan blue dye when mixed and delivered with Condroitinase ABC was about 57 $mm^2$, 75 $mm^2$, 79 $mm^2$, 81 $mm^2$ and 88 $mm^2$ at 2.5, 5, 10, 15 and 20 minutes after injection, respectively. The average dispersion area of trypan blue dye when mixed and delivered with *Streptomyces hyalurolyticus* lyase was about 74 $mm^2$, 76 $mm^2$, 101 $mm^2$, 103 $mm^2$ and 130 $mm^2$ at 2.5, 5, 10, 15 and 20 minutes after injection, respectively.

TABLE 34

Group Mean Summary of Dye Dispersion Areas ($mm^2$)

| Group | Test Article | Dye Dispersion Areas ($mm^2$) | | | | |
|---|---|---|---|---|---|---|
| | | 2.5 min | 5 min | 10 min | 15 min | 20 min |
| 1 | Neutral pH Buffer Vehicle/Control | 36.11 | 41.63 | 47.19 | 52.47 | 51.34 |
| 2 | Low pH Buffer | 33.34 | 34.47 | 41.88 | 44.91 | 51.18 |
| 3 | PEG PH20 (10 U/mL) | 37.28 | 47.08 | 52.40 | 54.94 | 58.17 |
| 4 | rHuPH20 (10 U/mL) | 44.58 | 66.02 | 79.46 | 86.24 | 101.90 |
| 5 | Hyal I (10 U/mL) | 31.53 | 36.27 | 39.60 | 46.41 | 48.21 |
| 6 | Chondroitinase ABC (10 U/mL) | 56.85 | 75.06 | 78.60 | 81.44 | 87.85 |
| 7 | Chondroitinase AC (1 U/mL) | 75.67 | 106.56 | 106.49 | 110.43 | 115.82 |
| 8 | Strep lyase (100 U/mL) | 73.97 | 75.58 | 101.03 | 102.69 | 129.56 |
| 9 | Humulin R | 38.22 | 43.94 | 50.76 | 52.49 | 58.41 |

2. Blood Glucose Levels

Table 35 sets forth the mean blood glucose levels (mg/dL) following administration of each test article. The blood glucose levels in mice administered dye and buffer only increased from an average of approximately 212 mg/dL prior to injection to approximately 332 mg/dL at 5 minutes post injection. Thereafter, the levels gradually rose to approximately 367 mg/dL at 20 minutes post injection. This increase of blood glucose in the absence of insulin is due to a well known effect of anesthetics on blood glucose in rodents (see, e.g. Saha et al., (2005) Exp. Biol. Med. 230:777-784). When Humulin® insulin was administered, the blood glucose levels rose briefly to an average of about 292 mg/dL at 5 minutes post injection (from average of about 226 mg/dL prior to injection) before dropping to an average of about 171 mg/dL, 122 mg/dL and 97 mg/dL at 10, 15 and 20 minutes post injection, respectively. While all of the hyaluronan degrading enzymes lowered blood glucose levels when administered with Humulin® insulin, co-administration of rHuPH20, PEG PH20, Chondroitinase ABC and *Streptomyces hyalurolyticus* lyase appeared to reduce levels even faster than observed with Humulin® insulin alone.

TABLE 35

Group Mean Summary of Blood Glucose Level (mg/dL)

| Group | Test Article | Blood Glucose Level (mg/dL) | | | | |
|---|---|---|---|---|---|---|
| | | 0 min | 5 min | 10 min | 15 min | 20 min |
| 1 | Neutral pH Buffer Vehicle/Control | 212.00 | 332.00 | 344.00 | 3.61.33 | 367.67 |
| 2 | Low pH Buffer | 196.67 | 259.67 | 249.33 | 231.33 | 220.67 |
| 3 | PEG PH20 (10 U/mL) | 170.00 | 196.67 | 110.00 | 68.33 | 46.67 |
| 4 | rHuPH20 (10 U/mL) | 165.67 | 173.00 | 96.00 | 63.67 | 39.00 |
| 5 | Hyal I (10 U/mL) | 155.67 | 201.33 | 144.33 | 77.00 | 52.67 |
| 6 | Chondroitinase ABC (10 U/mL) | 129.67 | 123.67 | 65.00 | 44.67 | 21.00 |
| 7 | Chondroitinase AC (1 U/mL) | 174.33 | 248.67 | 204.67 | 165.33 | 133.67 |

TABLE 35-continued

Group Mean Summary of Blood Glucose Level (mg/dL)

| Group | Test Article | Blood Glucose Level (mg/dL) | | | | |
|---|---|---|---|---|---|---|
| | | 0 min | 5 min | 10 min | 15 min | 20 min |
| 8 | Strep lyase (100 U/mL) | 140.33 | 120.67 | 68.67 | 41.00 | 27.67 |
| 9 | Humulin R | 226.33 | 292.00 | 171.33 | 122.33 | 96.67 |

Example 10

PEGylation of rHuPH20

A. Conjugation of InPEGSBA-30K to rHuPH20

In order to generate a PEGylated soluble human hyaluronidase, rHuPH20 (which is approximately 60 KDa in size) was covalently conjugated to a linear N-hydroxysuccinimidyl ester of methoxy poly(ethylene glycol) butanoic acid (mPEG-SBA-30K), having an approximate molecular weight of 30 kDa. The structure of mPEG-SBA is shown in scheme 2, below:

Scheme 2

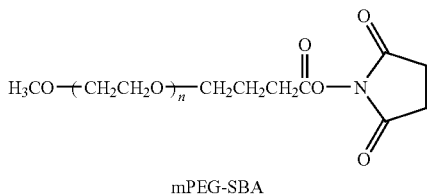

mPEG-SBA

Methods used to prepare the mPEG-SBA-30K that was used to PEGylate rHuPH20 are described, for example, in U.S. Pat. No. 5,672,662). Briefly, the mPEG-SBA-30K is made according to the following procedure:

A solution of ethyl malonate (2 equivalents) dissolved in dioxane is added drop by drop to sodium hydride (2 equivalents) and toluene under a nitrogen atmosphere. mPEG methane sulfonate (1 equivalent, MW 30 kDa, Shearwater) is dissolved in toluene and added to the above mixture. The resulting mixture is refluxed for approximately 18 hours. The reaction mixture is concentrated to half its original volume, extracted with 10% aqueous NaCl solution, extracted with 1% aqueous hydrochloric acid, and the aqueous extracts are combined. The collected aqueous layers are extracted with dichloromethane (3×) and the organic layer is dried with magnesium sulfate, filtered and evaporated to dryness. The resulting residue is dissolved in 1N sodium hydroxide containing sodium chloride and the mixture is stirred for 1 hour. The pH of the mixture is adjusted to approximately 3 by addition of 6N hydrochloric acid. The mixture is extracted with dichloromethane (2×).

The organic layer is dried over magnesium sulfate, filtered, concentrated, and poured into cold diethyl ether. The precipitate is collected by filtration and dried under vacuum. The resulting compound is dissolved in dioxane and refluxed for 8 hours and then concentrated to dryness. The resulting residue is dissolved in water and extracted with dichloromethane (2×), dried over magnesium sulfate, and the solution is concentrated by rotary evaporation and then poured into cold diethyl ether. The precipitate is collected by filtration and dried under vacuum. The resulting compound (1 equivalent) is dissolved in dichloromethane and N-hydroxysuccinimide (2.1 equivalents) is added. The solution is cooled to 0° C. and a solution of dicyclohexylcarbodiimide (2.1 equivalents) in dichloromethane is added dropwise. The solution is stirred at room temperature for approximately 18 hours. The reaction mixture is filtered, concentrated and precipitated in diethyl ether. The precipitate is collected by filtration and dried under vacuum to afford mPEG-SBA-30K.

To make the PEGylated rHuPH20, mPEG-SBA-30K was coupled to the amino group(s) of rHuPH20 by covalent conjugation, providing stable amide bonds between rHuPH20 and mPEG, as shown in Scheme 3.

Scheme 3:

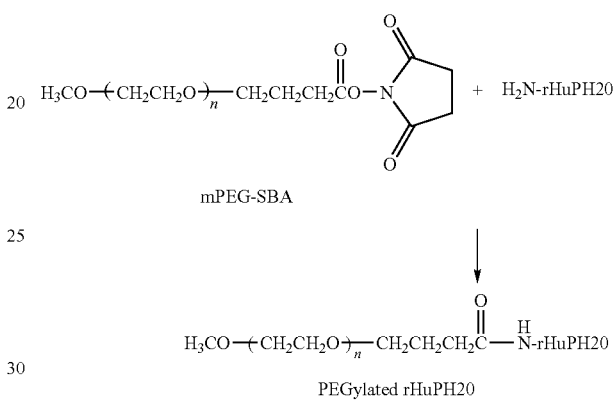

For the conjugation, the mPEG-SBA-30K was added in powder form to rHuPH20 (at a concentration of 10 mg/mL in 130 mM NaCl/10 mM HEPES; pH 7). The PEG:rHuPH20 ratio was 10:1 (molar ratio). After the PEG had dissolved in the buffer, the solution was sterile-filtered (Corning 50 mL Tube top filter, polystyrene, cellulose acetate 0.22 μm membrane). The conjugation was carried out overnight, with stirring, at 4° C. in a cold room.

Following conjugation, the solution was concentrated, using a 100,000 MWCO TFF membrane, and buffer exchanged against 130 mM NaCl/10 mM HEPES at pH 6.8. The resulting material, which was tested for enzyme activity, as described in Example 2, above, was diluted using 130 mM NaCl/10 mM HEPES at pH 6.8 to obtain a final enzyme activity of 100,000 U/mL (corresponding to approximately 2.5 mg peptide/mL). This PEGylated rHuPH20 material was filled, in 1 mL volumes, into a 13-mm Type-1 glass vial with brombutyl seal, and stored frozen (frozen overnight in a −80° C. freezer, then put in a −20° C. freezer for longer storage).

B. Analysis of PEGylated rHuPH20

The PEGylated rHuPH20 material was assayed by gel electrophoresis. Three batches of PEGylated rHuPH20, made as in Example 7A above, revealed an identical pattern of multiple bands, representing unreacted PEG and multiple species of mPEG-rHuPH20 conjugates, which migrated at different distances. Based on comparison with migration of a molecular weight marker, the bands representing the species ranged from approximately 90 KDa to 300 KDa, with three dark bands migrating above the 240 KDa marker. These data indicated that the PEGylated rHuPH20, generated by covalent conjugation of mPEG-SBA-30K, contained a heterogeneous mixture of PEGylated rHuPH20 species, likely including mono-, di- and tri-PEGylated proteins. The lack of a visible band at 60 KDa suggested that all the protein had reacted with the PEG, and that no detectable native rHuPH20 was present in the mixture.

Example 11

Effect of rHuPH20 on the Pharmacokinetics of Insulin Following Subcutaneous Administration in Pigs To determine whether a pig model would be suitable for modeling the pharmacokinetics of prandial insulins coadministered with recombinant hyaluronidase (e.g. rHuPH20), the pharmacokinetics of Humalog® insulin lispro and Humulin® R insulin after subcutaneous injection with or without rHuPH20 in pigs was assessed. The results were then compared to those observed in humans (see Example 1), to determine whether the pig model accurately reflected that seen in humans.

Briefly, Humalog® insulin lispro and Humulin® R insulin, with and without rHuPH20, were administered subcutaneously to six pigs in a randomized, 4-way crossover study. Each animal received three cycles of treatment with all four test articles to facilitate comparison of the reproducibility of the insulin pharmacokinetics over a series of dosing cycles. Blood samples were collected and the serum was assessed for to determine the levels of immunoreactive insulin (IRI). Various pharmacokinetic parameters, including $t_{max}$, $C_{max}$, Early $t_{50\%}$, Late $t_{50\%}$, and $AUC_{max}$ were then determined.

A. Dosing and Sampling

Dosing solutions (or test articles) of 100 U/mL Humalog® insulin lispro or Humulin® R insulin, with and without 4800 U/mL rHuPH20, were prepared as follows. The 100 Humalog® insulin lispro alone and Humulin® R insulin alone solutions were prepared from commercial lots of Humalog® insulin lispro (100 U/mL; Lot A418976, Eli Lilly) and Humulin® R insulin (100 U/mL; Lot A393318, Eli Lilly, diluted 1:5 with Sterile Diluent (Eli Lilly), respectively. To prepare the Humalog® insulin lispro/rHuPH20 solution, 910 μL of 100 U/mL Humalog® insulin lispro (Eli Lilly, Lot A418976), 44.6 mL HYLENEX recombinant (hyaluronidase human injection) (Baxter, Lot 903646) and 45.4 μL rHuPH20 API 1 mg/mL (Halozyme Therapeutics, Lot HUA0703MA) was mixed for a final Humalog® insulin lispro concentration of 91 U/mL and a hyaluronidase activity of 5454 U/mL. To prepare the Humulin® R insulin/rHuPH20 solution, 200 μL of 500 U/mL Humulin® R insulin (Eli Lilly, Lot A393318) and 800 μL rHuPH20 Drug Product 6000 U/mL (Halozyme, Lot 288004; rHuPH20 Drug Product contained 50 μg rHuPH20 in 145 mM NaCl, 10 mM Sodium Phosphate Dibasic, 2.7 mM Calcium Chloride, 2.7 mM EDTA Disodium Salt, 1 mg/mL Human Serum Albumin, pH 7.4) was mixed for a final insulin concentration of 100 U/mL and rHuPH20 hyaluronidase activity of 4800 U/mL.

The solutions containing rHuPH20 were sterile filtered and filled into 2 mL Type-I glass (Wheaton) vials and sealed with 13-mm rubber (Stelmi) stoppers. The solutions containing rHuPH20 were then split into two sets; one was kept as a refrigerated control until tested and the other was used for administration to the animals in this study. All dosing solutions were kept refrigerated at all times and then returned for testing. Each set of solutions were tested for rHuPH20 enzyme activity on the same date, within 1-6 days of being formulated.

Six adult male Yucatan pigs (S&S Farms, Ramona, Calif.), each weighing between 21 and 25 kg at the initiation of the study, were equipped with surgically implanted jugular vein or carotid artery catheters with exterior vascular access ports installed for easy blood sampling throughout the study. The animals were quarantined for 7 days prior to instrumentation and treatment. Six animals were randomized to two study groups as shown in Table 36, below. The animals were assigned to one of two groups each containing 3 animals per group and the assignment was maintained for cycles 1 and 2. For a third dosing cycle, two animals were dropped due to non-patency of the cannulae, and the remaining four animals were reassigned with only 2 animals per group. Group 1 animal ID numbers were 540, 541, and 542 for cycles 1 and 2; and 542 and 544 for cycle 3. Group 2 animal ID numbers: 544, 545, and 546 for cycles 1 and 2; 545 and 546 for cycle 3.

The dosing solutions were administered subcutaneously (SC) into the left flank of each pig behind the midline of the body. Prior to administration of test article, a pre-treatment blood sample was obtained. Animals received a single SC dose of the appropriate test article (0.2 U/kg; with animal measured prior to each administration to accurately determine the correct dose) in an every-other day protocol. Each animal received a single SC bolus dose of the indicated insulin (i.e., either insulin or lispro) at 0.2 U/kg in either a vehicle or in a fresh co-formulation of rHuPH20. After administration of the test article, at least 0.7-1.0 mL blood was serially withdrawn at 3, 6, 9, 12, 15, 20, 25, 30, 45, 60, 90, 120, 180 and 240 minutes. A pre-treatment bleed (pre-bleed) also was taken prior to administration. The blood samples were immediately placed into serum tubes containing no anti-coagulant, placed on ice for a minimum of 30 minutes, then centrifuged at 9500×g for 5 minutes at ambient temperature. The serum was then transferred into a pre-labeled tube, frozen, and stored at −80° C., until all samples were shipped to Millipore for bioanalysis for the immunoreactive insulin (IRI) levels.

TABLE 36

Dosing protocol for validation of pig model

| Cycle | Dosing Day | Study Day | Group #1 Treatment | Group #2 Treatment |
|---|---|---|---|---|
| 1 | 1 | 0 | Humalog ® insulin lispro | Humulin ® R insulin |
|  | 2 | 2 | Humulin ® R insulin/rHuPH20 | Humalog ® insulin lispro/rHuPH20 |
|  | 3 | 4 | Humulin ® R insulin | Humalog ® insulin lispro |
|  | 4 | 6 | Humalog ® insulin lispro/rHuPH20 | Humulin ® R insulin/rHuPH20 |
| 2 | 5 | 8 | Humalog ® insulin lispro | Humulin ® R insulin |
|  | 6 | 10 | Humulin ® R insulin/rHuPH20 | Humalog ® insulin lispro/rHuPH20 |
|  | 7 | 12 | Humulin ® R insulin | Humalog ® insulin lispro |
|  | 8 | 14 | Humalog ® insulin lispro/rHuPH20 | Humulin ® R insulin/rHuPH20 |
| 3 | 9 | 26 | Humalog ® insulin lispro | Humulin ® R insulin |
|  | 10 | 28 | Humulin ® R insulin/rHuPH20 | Humalog ® insulin lispro/rHuPH20 |
|  | 11 | 30 | Humalog ® insulin lispro/rHuPH20 | Humulin ® R insulin/rHuPH20 |
|  | 12 | 32 | Humulin ® R insulin | Humalog ® insulin lispro |

B. Serum Insulin Levels

The serum IRI concentrations were determined for each serum sample by interpolation from a standard curve using StatLIAOR assay analysis software (Brendan Technologies, Carlsbad, Calif.). Table 37 provides the IRI concentration following administration of Humalog® insulin lispro, Humalog® insulin lispro/rHuPH20, Humulin® R insulin or Humulin® R insulin/rHuPH20. Table 37 sets forth the baseline IRI levels, as measured in the pre-bleed samples. These baselines were then subtracted from the actual IRI concentrations measured at each timepoint to determine the baseline-adjusted IRI concentration.

The mean serum IRI concentration-time profiles for each treatment (as seen when plotted on a graph with IRI concentration on the Y axis versus time on the X axis) was similar over multiple cycles. In all dosing cycles, the pharmacokinetics of Humalog® insulin lispro and Humulin® R insulin were accelerated when co-administered subcutaneously in the rHuPH20 formulation. Any observed differences between treatments were substantially the same among treatment cycles, indicating the observed differences were due to the treatment and were stable across the cycles, over approximately 5 weeks of testing.

C. Insulin Pharmacokinetics

The insulin concentration-time profile after subtraction of the baseline insulin concentration (Table 37, above) was used to calculate the following PK parameters: including $t_{max}$, $C_{max}$, Early $t_{50\%}$, Late $t_{50\%}$, and $AUC_{interval}$. PK parameters were derived by non-compartmental analysis using model 200 in WinNonlin Professional version 5.2 (Pharsight Corp., Mountain View, Calif.). Calculations of statistics were performed using SAS version 9.1.3 (SAS Institute, Cary, N.C.). All analyses were performed using a mixed model with fixed effects for treatment. A compound symmetric covariance matrix among repeated observations for each animal was assumed. Analyses for Coax and all AUC endpoints were performed using log-transformed values with values of zero replaced by 1 prior to log transformation (zero on the log scale). The time based endpoints were analyzed on the original linear scale.

A summary of the pharmacokinetics of insulin following subcutaneous administration of Humalog® insulin lispro or Humulin® R insulin, delivered alone (control) or with rHuPH20, is provided in Table 38. The various PK parameters for each insulin delivered alone or with rHuPH20 is shown as Mean±SD. The % control for each parameter (% control calculated by [mean (geometric or arithmetic) PK value for insulin with rHuPH20]/[mean (geometric or arithmetic) PK value for insulin alone]×100) also is provided in the table. The % control calculations were based on Geometric Mean and p-value for log transformed data for $C_{max}$ and AUC parameters, while based on arithmetic mean and untransformed values for $t_{max}$ and Early & Late $t_{50\%}$. N=16 pigs unless otherwise noted.

Table 39 sets forth a comparison of PK parameters of Humalog® insulin lispro alone to Humulin® R insulin with rHuPH20. The PK values are provided as Mean±SD. Also provided is the % Humalog® insulin lispro (i.e. [mean (geometric or arithmetic) PK value for Humalog® insulin lispro with rHuPH20]/[mean (geometric or arithmetic) PK value for Humalog® insulin lispro alone]×100). The % control calculations were based on Geometric Mean and p-value for log transformed data for $C_{max}$ and AUC parameters, or based on arithmetic mean and untransformed values for $t_{max}$ and Early & Late $t_{50\%}$. N=16 unless otherwise noted.

TABLE 37

Serum IRI concentration-time profiles

Mean IRI concentration (pM) and standard deviation (SD)

| Time (minutes) | Humalog® insulin lispro Mean | SD | Humalog® insulin lispro/ rHuPH20 Mean | SD | Humulin® R insulin Mean | SD | Humulin® R insulin/ rHuPH20 Mean | SD |
|---|---|---|---|---|---|---|---|---|
| 0 (pre-bleed baseline) | 37.0 | 52.3 | 45.0 | 37.5 | 20.9 | 27.3 | 19.2 | 23.8 |
| Baseline-adjusted IRI concentrations | | | | | | | | |
| 0 | 0 | 0 | 0 | 0 | 0 | 0 | 0 | 0 |
| 3 | 8.1 | 25.2 | 65.5 | 79.3 | 0.7 | 3.0 | 113.0 | 109.7 |
| 6 | 20.6 | 46.1 | 110.3 | 84.6 | 2.9 | 7.1 | 161.6 | 119.4 |
| 9 | 21.5 | 40.9 | 166.0 | 122.5 | 3.7 | 10.9 | 168.1 | 136.2 |
| 12 | 40.6 | 71.6 | 143.0 | 99.0 | 7.3 | 20.7 | 166.0 | 118.0 |
| 15 | 52.3 | 78.4 | 262.2 | 215.5 | 11.2 | 32.8 | 155.6 | 114.8 |
| 20 | 80.4 | 125.6 | 265.3 | 169.2 | 22.6 | 33.7 | 210.8 | 172.4 |
| 25 | 93.6 | 92.5 | 263.3 | 190.0 | 40.7 | 48.2 | 253.0 | 171.9 |
| 30 | 119.7 | 116.7 | 335.2 | 220.4 | 61.3 | 55.1 | 224.1 | 146.5 |
| 45 | 193.9 | 139.7 | 296.1 | 183.3 | 105.6 | 103.8 | 253.1 | 188.1 |
| 60 | 164.0 | 106.8 | 206.5 | 150.3 | 107.0 | 91.4 | 172.4 | 115.3 |
| 90 | 115.2 | 76.4 | 101.8 | 74.4 | 100.4 | 95.4 | 137.0 | 110.0 |
| 120 | 95.7 | 68.9 | 72.3 | 63.6 | 105.5 | 57.6 | 93.9 | 63.4 |
| 180 | 24.6 | 23.6 | 38.5 | 45.4 | 105.5 | 81.7 | 50.5 | 49.7 |
| 240 | 15.2 | 21.7 | 65.8 | 106.5 | 81.8 | 126.3 | 33.8 | 50.9 |

TABLE 38

Insulin PK parameters following subcutaneous administration with or without rHuPH20

| | Humalog® insulin lispro | | | | Humulin® R insulin | | | |
|---|---|---|---|---|---|---|---|---|
| | alone | with rHuPH20 | % control | P-value | alone | with rHuPH20 | % control | P-value |
| $C_{max}$ (pmol/L) | 250 ± 140 | 417 ± 229 | 163 | 0.0251 | 214 ± 122 | 360 ± 180 | 165 | 0.0218 |
| Early $t_{50\%}$ (min) | 36 ± 20a | 11 ± 6a | 32 | 0.0182 | 61 ± 49 | 10 ± 8a | 17 | <0.0001 |
| $t_{max}$ (min) | 58 ± 26 | 39 ± 39 | 67 | 0.1963 | 94 ± 61 | 38 ± 41 | 40 | 0.0004 |
| Late $t_{50\%}$ (min) | 110 ± 42a | 52 ± 24a | 47 | 0.0002 | 170 ± 49b | 70 ± 41a | 42 | <0.0001 |
| AUC interval (min × nmol/L) | | | | | | | | |
| 0-15 min | 0.35 ± 0.64 | 1.77 ± 1.24 | 1961 | 0.0004 | 0.06 ± 0.17 | 2.06 ± 1.28 | 43542 | <0.0001 |
| 0-30 min | 1.65 ± 2.07 | 5.84 ± 3.59 | 763 | 0.0198 | 0.56 ± 0.73 | 5.33 ± 3.30 | 1429 | 0.0027 |
| 0-1 hr | 6.7 ± 4.8 | 14.2 ± 8.6 | 214 | 0.2776 | 3.4 ± 2.5 | 12.1 ± 7.3 | 246 | 0.2003 |

TABLE 38-continued

Insulin PK parameters following subcutaneous administration with or without rHuPH20

|  | Humalog ® insulin lispro | | | | Humulin ® R insulin | | | |
| --- | --- | --- | --- | --- | --- | --- | --- | --- |
|  | alone | with rHuPH20 | % control | P-value | alone | with rHuPH20 | % control | P-value |
| 0-last | 18.0 ± 8.8 | 26.6 ± 14.6 | 146 | 0.1195 | 21.3 ± 12.1 | 26.9 ± 16.0 | 116 | 0.5312 |
| 0-infinity | 24.3 ± 8.6c | 32.2 ± 17.1a | 117 | 0.5176 | 45.0 ± 41.2c | 32.6 ± 16.7a | 88 | 0.6118 |
| 1-4 hr | 12.2 ± 6.8 | 12.9 ± 7.8 | 106 | 0.8410 | 18.2 ± 10.3 | 15.0 ± 10.1 | 72 | 0.2259 |
| 2-4 hr | 4.9 ± 3.2 | 6.0 ± 4.9 | 215 | 0.3763 | 12.0 ± 7.8 | 6.8 ± 5.4 | 32 | 0.1930 | aN = 15
bN = 4
cN = 13

TABLE 39

Insulin PK parameters following subcutaneous administration of Humalog ® insulin lispro alone or Humulin ® R insulin with rHuPH20.

|  | Humalog ® insulin lispro | Humulin ® R insulin with rHuPH20 | % Humalog ® insulin lispro | P-value |
| --- | --- | --- | --- | --- |
| $C_{max}$ (pmol/L) | 250 ± 140 | 360 ± 180 | 143 | 0.0944 |
| Early $t_{50\%}$ (min) | 36 ± 20a | 10 ± 8a29 |  | 0.0141 |
| $t_{max}$ (min) | 58 ± 26 | 38 ± 41 | 64 | 0.1631 |
| Late $t_{50\%}$ (min) | 110 ± 42a | 70 ± 41a | 64 | 0.0092 |
| AUC interval (min × nmol/L) | | | | |
| 0-15 min | 0.35 ± 0.64 | 2.06 ± 1.28 | 2698 | <0.0001 |
| 0-30 min | 1.65 ± 2.07 | 5.33 ± 3.32 | 744 | 0.0212 |
| 0-1 hr | 6.7 ± 4.8 | 12.1 ± 7.3 | 189 | 0.3646 |
| 0-last | 18.0 ± 8.8 | 26.9 ± 16.0 | 146 | 0.1196 |
| 0-infinity | 24.3 ± 8.6b | 32.6 ± 16.6a | 128 | 0.3179 |
| 1-4 hr | 12.2 ± 6.8 | 15.0 ± 10.1 | 121 | 0.4801 |
| 2-4 hr | 4.9 ± 3.2 | 6.9 ± 5.4 | 290 | 0.2203 | aN = 15
bN = 13

D. Summary

Co-administration of Humulin® R insulin or Humalog® insulin lispro with rHuPH20 in pigs significantly altered specific PK parameters relative to control injections (i.e. Humulin® R insulin or Humalog® insulin lispro alone). Specifically, the maximum exposure ($C_{max}$) was increased 163% for Humalog® insulin lispro (p=0.0251) and 165% for Humulin® R insulin (p=0.0218) when administered with rHuPH20 relative to the respective controls. The onset of action (Early $t_{50\%}$) was accelerated from 36 to 11 minutes for Humalog® insulin lispro (p=0.0182) and from 61 to 10 minutes for Humulin® R insulin (p<0.0001). The time of maximum effect ($t_{max}$) was accelerated from 58 to 39 minutes for Humalog® insulin lispro (p=0.1963) and from 94 to 38 minutes for Humulin® R insulin (p=0.0004). The Late $t_{50\%}$ was accelerated from 110 to 52 minutes for Humalog® insulin lispro (p=0.0002) and from 170 to 70 minutes for Humulin® R insulin (p<0.0001). Total exposure ($AUC_{inf}$) was not meaningfully altered for either Humalog®(V insulin lispro (117% control; p=0.5176) or Humulin® R insulin (88% control; p=0.6118). Cumulative exposure was shifted to earlier time windows for both Humalog® insulin lispro ($AUC_{0-30}$ increased 763% compared to when Humalog® insulin lispro was administered alone; p=0.0198) and Humulin® R insulin ($AUC_{0-30}$ increased 1429% compared to when Humulin® R insulin was administered alone; p=0.0027). Coadministration of either Humulin® R insulin with rHuPH20 or Humalog® insulin lispro with rHuPH20 increased the absorption rate of insulin to the vascular compartment (compared to when the respective insulin was delivered alone) as evidenced by a reduction in time to maximum serum IRI concentrations ($t_{max}$, Early $t_{50\%}$, Late $t_{50\%}$), and an increase in peak exposure concentrations ($C_{max}$) compared to Humulin®V R insulin or Humalog® insulin lispro alone. In addition, early cumulative exposure ($AUC_{0-30}$) was increased for both Humalog® insulin lispro and Humulin® R insulin when coadministered with rHuPH20, compared to when administered alone.

The increase in peak exposure and acceleration of exposure upon administration of either Humalog® insulin lispro and Humulin® R insulin with hyaluronidase coadministration were observed broadly without meaningful impact on animal, sequence, or cycle, and closely mirror the previous human studies (see Example 1). Therefore, the pig is a suitable model for studying the effect of hyaluronidase on the absorption of prandial insulin preparations.

Example 12

Pharmacokinetics of Regular Insulin at Two Doses Administered with and without rHuPH20 Subcutaneously The pharmacokinetics (PK) of regular insulin, when subcutaneously administered at two different concentrations, both alone and co-administered with rHuPH20, was assessed in the porcine model described in Example 10, above. A multiple dose 4-way crossover design study was conducted to compare the PK of regular insulin at concentrations of 20 and 100 U/mL, when administered alone, to the same two concentrations after co-administration with rHuPH20. In each case, a total of 0.2 U/kg of insulin was administered.

A. Dosing and Sampling

Four test articles were prepared for dosing. Two test articles contained 20 U/mL and 100 U/mL regular insulin (Humulin® R insulin; Eli Lilly), respectively (designated Insulin U20 and Insulin U 100, respectively). The remaining two test articles contained 20 U/mL and 100 U/mL regular insulin (Diosynth Biotechnologies (a division of Schering-Plough), respectively, with 20 µg/mL (approximately 2400 U/mL) rHuPH20 (designated Insulin-PH20 U20 and Insulin-PH20 U100, respectively). The Insulin U20 test article was prepared by diluting Humulin® R insulin (100 U/mL; Lot A390566A; Eli Lilly) 1:5 with sterile diluent (Eli Lilly). The Insulin U 100 test article was undiluted Humulin® R insulin (100 U/mL; Lot A509721; Eli Lilly). The Insulin-PH20 U20 test article contained 0.74 mg/mL (20 U/mL) regular insulin (Lot # SIHR107; Diosynth Biotechnologies) and 20 µg/mL (approximately 2400 U/mL) rHuPH20 in 25 mM Tris, 120 mM NaCl, 0.01% Polysorbate 80, pH 7.3. The Insulin-PH20 U100 test article contained 3.69 mg/mL (100 U/mL) regular insulin (Lot # SIHR107; Diosynth Biotechnologies) and 20 µg/mL (approximately 2400 U/mL) rHuPH20 in 25 mM Tris, 120 mM NaCl, 0.01% Polysorbate 80, pH 7.3.

Six adult male Yucatan mini pigs (S&S Farms, Ramona, Calif.), each weighing between 21 and 25 kg at the initiation of the study, had a catheter surgically implanted either in the jugular vein or the carotid artery to enable serial blood samples to be drawn over the duration of the study. The animals were randomized to two study groups, each containing 3 ammonals/group as shown in Table 40. The group assignment was maintained for cycles 1 and 2. Each animal received two cycles of treatment with all four test articles to facilitate comparison of the reproducibility of the insulin pharmacokinetics over a series of dosing cycles.

Test articles were administered subcutaneously (SC) into the left flank of each pig behind the midline of the body. Each animal received a single SC bolus dose of the indicated insulin at 0.2 U/kg in an every other day protocol. For the Insulin U20 and Insulin-PH20 U20 test articles, 10.0 µL/kg was administered. For the Insulin U100 and Insulin-PH20 U100 test articles, 2.0 µL/kg was administered. Blood samples (0.7-1.0 mL in volume) were collected prior to administration (pre-bleed), then at 3, 6, 9, 12, 15, 20, 25, 30, 45, 60, 90, 120, 180 and 240 minutes post administration. The blood samples were placed into serum tubes containing no anti-coagulant, placed on ice for a minimum of 30 minutes, then centrifuged at 9500×g for 5 minutes at ambient temperature. The serum was then transferred into a pre-labeled tube, frozen, and stored at −80° C. until samples were shipped to Millipore BioPharma Services (St. Charles, Mo.) to determine the levels of immunoreactive insulin (IRI).

TABLE 40

Dosing protocol

| Cycle | Dose | Day | Group 1 | Group 2 |
|---|---|---|---|---|
| 1 | 1 | 0 | Insulin-PH20 U100 | Insulin U20 |
|   | 2 | 2 | Insulin-PH20 U20 | Insulin U100 |
|   | 3 | 4 | Insulin U100 | Insulin-PH20 U20 |
|   | 4 | 6 | Insulin U20 | Insulin-PH20 U100 |
| 2 | 5 | 8 | Insulin-PH20 U20 | Insulin U100 |
|   | 6 | 10 | Insulin U20 | Insulin-PH20 U100 |
|   | 7 | 12 | Insulin-PH20 U100 | Insulin U20 |
|   | 8 | 14 | Insulin U100 | Insulin-PH20 U20 |

B. Serum Insulin Levels

The serum IRI concentrations were determined for each serum sample by interpolation from a standard curve using StatLIA® assay analysis software (Brendan Technologies, Carlsbad, Calif.). Table 41 provides the mean serum IRI concentration following administration of Insulin U20, Insulin U100, Insulin-PH20 U20 and Insulin-PH20 U100. Table 41 sets forth the baseline IRI levels, as measured in the pre-bleed samples. These baselines were then subtracted from the actual IR1 concentrations measured at each timepoint to determine the baseline-adjusted IR1 concentration.

The insulin concentration-time profiles after each cycle of dosing were compared for each treatment group. The mean serum IRI concentration-time profiles for each test article, as observed when plotted on a graph with IRI concentration on the Y axis versus time on the X axis) was similar over both cycles. In both dosing cycles, the PK of insulin was accelerated when co-administered subcutaneously with the rHuPH20 formulation for both concentrations. Additional statistical models that included fixed effects for treatment, sequence, cycle, the treatment-by-cycle interaction, and animal within sequence for data from cycles 1 and 2 were constructed for primary and secondary PK parameters (primary PK parameters included: Area Under the Curve (AUC) for assigned windows of time, $C_{max}$, $t_{max}$, Early $t_{50\%}$, and Late $t_{50\%}$%; secondary PK parameters included more detailed time windows for AUC, MRT (last and infinity), Lambda z, HL Lambda z, Clearance, and Volume of Distribution), and showed that there is no systematic effect of sequence, cycle, or animal, nor is there an interaction between cycle and treatment for the any of these variables.

TABLE 41

Serum IRI concentration-time profiles

| | Mean IRI concentration (pM) and standard deviation (SD) | | | | | | | |
|---|---|---|---|---|---|---|---|---|
| | Insulin U20 | | Insulin U100 | | Insulin-PH20 U20 | | Insulin-PH20 U100 | |
| Time (minutes) | Mean | SD | Mean | SD | Mean | SD | Mean | SD |
| 0 (pre-bleed baseline) | 91.6 | 53.0 | 89.0 | 49.6 | 114.3 | 55.8 | 71.8 | 48.4 |
| Baseline-adjusted IRI concentrations | | | | | | | | |
| 0 | 0.0 | 0.0 | 0.0 | 0.0 | 0.0 | 0.0 | 0.0 | 0.0 |
| 3 | 139.7 | 472.2 | 63.1 | 73.4 | 2.2 | 5.6 | 49.4 | 41.3 |
| 6 | 74.2 | 234.6 | 178.7 | 269.3 | 8.1 | 17.6 | 88.8 | 73.7 |
| 9 | 206.3 | 594.2 | 122.0 | 101.3 | 12.9 | 30.9 | 144.5 | 85.0 |
| 12 | 93.0 | 166.7 | 181.5 | 150.5 | 36.9 | 58.0 | 182.1 | 138.6 |
| 15 | 83.1 | 116.2 | 214.4 | 151.5 | 58.6 | 76.9 | 225.3 | 165.6 |
| 20 | 136.3 | 180.8 | 367.1 | 590.3 | 85.1 | 109.6 | 251.8 | 133.3 |
| 25 | 139.1 | 147.7 | 247.3 | 161.1 | 174.5 | 262.2 | 285.7 | 142.8 |
| 30 | 238.0 | 292.2 | 294.1 | 183.9 | 169.2 | 224.9 | 357.3 | 199.9 |
| 45 | 203.3 | 117.5 | 249.0 | 133.5 | 134.3 | 147.6 | 234.7 | 115.8 |
| 60 | 185.5 | 127.6 | 174.8 | 101.8 | 102.5 | 65.1 | 252.1 | 169.1 |
| 90 | 106.1 | 67.7 | 131.2 | 128.1 | 85.4 | 87.8 | 222.7 | 144.7 |
| 120 | 70.8 | 71.9 | 73.0 | 47.0 | 70.9 | 61.7 | 153.7 | 54.8 |
| 180 | 78.0 | 92.3 | 64.2 | 119.3 | 87.4 | 101.3 | 69.4 | 59.1 |
| 240 | 25.7 | 32.2 | 26.0 | 44.7 | 23.0 | 36.9 | 23.3 | 26.5 |

C. Insulin Pharmacokinetics

The insulin concentration-time profile after subtraction of the baseline insulin concentration (Table 41, above) was used to calculate the following PK parameters: including $t_{max}$, $C_{max}$, Early $t_{50\%}$, Late $t_{50\%}$, and $AUC_{interval}$. Serum IRI versus time data were modeled by non-compartmental analysis using WinNonlin Professional model 200 (Version 5.2, Pharsight Corp., Mountain View, Calif.) and the PK parameters calculated. Calculations of statistics and statistical comparisons between groups were performed using SAS version 9.1.3 (SAS Institute, Cary, N.C.). All analyses were performed using a mixed model with fixed effects for treatment. A compound symmetric covariance matrix among repeated observations for each animal was assumed. Analyses for $C_{max}$ and all AUC endpoints were performed using log-transformed values with values of zero replaced by 1 prior to log transformation (zero on the log scale). The time based endpoints were analyzed on the original linear scale.

A summary of the pharmacokinetics of insulin following subcutaneous administration of Insulin U20, Insulin U 100, Insulin-PH20 U20 and Insulin-PH20 U100, is provided in Table 42. The various PK parameters for each insulin delivered alone or with rHuPH20 is shown as Mean SD. The % control for each parameter (% control=[PK value for insulin with rHuPH20]/[PK value for insulin alone]×100) also is provided in the table. The % control calculations were based on Geometric Mean and p-value for log transformed data for $C_{max}$ and AUC parameters, while % control calculations were based on arithmetic mean and untransformed values for $t_{max}$ and Early & Late $t_{50\%}$. N=16 pigs unless otherwise noted.

At the lower insulin concentration of 20 U/mL, co-administration with rHuPH20 resulted in the following effects on insulin PK, compared to administration of insulin alone: 1)

TABLE 42

Insulin PK parameters following subcutaneous administration with or without rHuPH20

| | Insulin 20 U/mL | | | | Insulin 100 U/mL | | | |
|---|---|---|---|---|---|---|---|---|
| | Insulin 20U | Insulin-rHuPH20 20U | % control | P-value | Insulin 100U | Insulin-rHuPH20 100U | % control | P-value |
| $C_{max}$ (pmol/L) | 429 ± 508 | 462 ± 567 | 106 | 0.8439 | 238 ± 237 | 420 ± 208 | 237 | 0.0095 |
| Early $t_{50\%}$ (min) | 23 ± 14b | 12 ± 5 | 52 | 0.1622 | 35 ± 38$_c$ | 12 ± 7 | 34 | 0.0063 |
| $t_{max}$ (min) | 57 ± 42 | 39 ± 21 | 68 | 0.2462 | 64 ± 49 | 47 ± 29 | 74 | 0.2775 |
| Late $t_{50\%}$ (min) | 84 ± 38$_b$ | 77 ± 45 | 92 | 0.7689 | 109 ± 64$_c$ | 112 ± 53 | 103 | 0.9315 |
| AUC interval (min × nmol/L) | | | | | | | | |
| 0-15 min | 1.61 ± 4.37 | 1.95 ± 1.73 | 1920 | 0.0045 | 0.27 ± 0.40 | 1.75 ± 1.02 | 7104 | <0.0001 |
| 0-30 min | .79 ± 6.24 | 6.35 ± 5.90 | 623 | 0.0567 | 2.14 ± 2.83 | 5.89 ± 2.89 | 2400 | 0.0015 |
| 0-1 hr | 10.02 ± 8.60 | 13.75 ± 8.92 | 179 | 0.2073 | 6.19 ± 6.78 | 13.98 ± 6.0 | 489 | 0.0012 |
| 0-last | 24.4 ± 11.6 | 27.5 ± 20.5 | 107 | 0.8777 | 18.5 ± 16.0 | 34.7 ± 14.6 | 354 | 0.0038 |
| 0-infinity | 30.1 ± 10.3$_d$ | 29.8 ± 22.1 | 89 | 0.7027 | 27.8 ± 19.1$_e$ | 44.8 ± 13.2$_c$ | 214 | 0.0161 |
| 1-4 hr | 14.6 ± 9.6 | 14.2 ± 12.2 | 97 | 0.9436 | 13.2 ± 11.3 | 22.2 ± 11.2 | 270 | 0.0204 |
| 2-4 hr | 7.6 ± 6.5 | 6.5 ± 9.1 | 104 | 0.9720 | 8.1 ± 8.2 | 9.5 ± 5.4 | 398 | 0.1832 |

$_b$N = 11 animals
$_c$N = 10 animals
$_d$N = 8 animals
$_e$N = 9 animals

D. Summary

This study examined the effect of subcutaneously administering the same total insulin dose at different concentrations, with and without rHuPH20.

In the absence of co-administration with rHuPH20, reduction in the insulin concentration from 100 U/mL to 20 U/mL resulted in faster insulin absorption with an increase in peak insulin concentration and greater cumulative insulin exposure both early and, to a lesser extent, overall. Relative to control 100 U/mL injections, reducing the concentration to 20 U/mL 1) increased $C_{max}$ 91% from a geometric mean of 158 to 302 pmol/L; 2) reduced mean early $t_{50\%}$ from 35 to 23 minutes, $t_{max}$ from 64 to 57 minutes, and Late $t_{50\%}$ from 109 to 84 minutes; and 3) increased geometric mean $AUC_{0-15}$ 300% from 20 to 80, $AUC_{0-30}$ 256% from 222 to 791, and $AUC_{last}$ 131% from 9,021 to 20,820 all in units of pmol×min/L.

Co-administration of regular insulin at either concentration with rHuPH20 also resulted in faster absorption following subcutaneous injection relative to insulin alone. However, at the lower insulin concentration of 20 U/mL, the relative increases over insulin administered alone were not as dramatic as the insulin was already absorbed faster at 20 U/mL when delivered alone (as described above).

At the 100 U/mL concentration, which more typically is used by diabetic patients, co-injection with rHuPH20 1) increased $C_{max}$ 137% from a geometric mean of 158 to 375 pmol/L (p=0.0095); 2) reduced mean early $t_{50\%}$ from 35 to 12 minutes (p=0.0063), while $t_{max}$ and Late T50% were not significantly changed; and 3) increased geometric mean $AUC_{0-15}$ 70-fold from 20 to 1438 (p<0.0001), $AUC_{0-30}$ 23-fold from 222 to 5337 (p=0.0015), and $AUC_{last}$ 250% from 9,021 to 31,905 (p=0.0038) all in units of pmol×min/L, compared to administration of insulin alone at the 100 U/mL concentration.

$C_{max}$ was not significantly altered with geometric means of 302 and 322 pmol/L (p=0.84); 2) mean early $t_{50\%}$ trended lower from 23 to 12 minutes (p=0.16), while $t_{max}$ and Late $t_{50\%}$ were not significantly changed; and 3) Geometric mean $AUC_{0-15}$ increase 18-fold from 80 to 1533 (p=0.0045), $AUC_{0-30}$ 5-fold from 791 to 4934 (p=0.0567), and $AUC_{last}$ was unchanged at 20,820 and 22,184 (p=0.88) all in units of pmol×min/L.

The increase in peak exposure and acceleration of exposure upon administration of rHuPH20 and regular insulin at 100 U/mL relative to control insulin injection without rHuPH20, closely mirror the previous human studies (Example 1) pig study (Example 10). These results further demonstrate that insulin kinetics also can be accelerated by administration at a lower concentration, which is consistent with a rate-limiting insulin hexamer dissociation step which is concentration dependent (i.e. when insulin is administered subcutaneously alone, it is absorbed when it dissociates from a hexamer to monomers, a process that occurs at lower concentrations of insulin). When co-administered with rHuPH20, this dependence on insulin concentration is greatly reduced or even eliminated. Thus, the hyaluronidase dispersing effect of co-administration of rHuPH20 with insulin can reduce the unwanted slow down in insulin pharmacokinetics that is observed with injection of insulin at higher concentrations.

Example 13

Effect of Salt Concentration on Rhuph20 in the Presence of Methylparaben

The effect of NaCl on the stability of rHuPH20 with and without the preservative methylparaben, at accelerated temperature (40° C.) was evaluated. Twelve different formulations were prepared by combining rHuPH20 (10 mg/ml in histidine/HCl, pH 6.5, 130 mM NaCl) with six different concentrations of NaCl, with or without Methylparaben (Fluka). Each formulation contained 10 μg/mL rHuPH20, 25 mM Tris, pH 7.3, 0.01% Tween 80 and either 0, 50 mM, 100 mM, 150 mM, 200 mM or 250 mM NaCl with or without 0.2% methyparaben. The solutions were aliquotted into 2 ml type I glass vials with rubber stoppers and sealed with alumina caps during the study. One set of vials was stored at 40° C. for four days, and the other set was kept in the refrigerator at 2-8° C. to serve as a positive control. The samples were then tested for hyaluronidase (enzymatic) activity. To evaluate the level of aggregates, size exclusion chromatography (SEC) was performed using a G2000 SWXL column (Tosoh Bioscience) the following conditions with 1×PBS as running buffer and a flow rate set at 1 ml/min.

Table 43 sets forth the results of the study, including hyaluronidase (enzymatic) activity, % main peak (i.e. the percentage of rHuPH20 that was contained in the main peak) and % aggregate peak (i.e. the percentage of rHuPH20 that was contained in the peak attributed to aggregates). It was observed that the stability of rHuPH20 was sensitive to the concentration of NaCl. In general, when the formulations were incubated at 40° C., as the NaCl concentration decreased, the enzymatic activity of rHuPH20 decreased. However, when stored in refrigerator at 2-8° C., the rHuPH20 retained enzymatic activity regardless of the formulation. At elevated temperature, when NaCl was completely eliminated from the solution, the entire activity of rHuPH20 was lost, whether there was methylparaben or not. The loss of enzymatic activity was reduced as the NaCl concentration increased. There was significant difference in enzymatic activity (paired t-test, P=0.0228) between samples with and without added methylparaben.

A similar correlation of NaCl concentration and the aggregate levels of rHuPH20 was observed. The aggregate levels increased with decreasing NaCl concentration when samples were stored at elevated temperature. There were essentially no changes with or without added methylparaben when stored at 2-8° C. The formulations stored at −40° C. containing methyparaben formed significantly more aggregate than those formulations that did not contain methylparaben (paired t-test, P=0.0058).

Thus, both the enzymatic activity and percent monomer of rHuPH20 as assessed by SEC were significantly reduced in formulations containing methylparaben as compared to those formulations that contained no methylparaben. Further, within the NaCl concentration range tested (0-250 mM), there was a direct relationship between NaCl concentration and increased rHuPH20 stability.

TABLE 43

Enzymatic activities and SEC results of the samples stored 4 days at 40° C. and 4° C.

| Formulation | Enzymatic activity (U/mL) | | % main peak | | % aggregate peak | |
|---|---|---|---|---|---|---|
| | 4° C. | 40° C. | 4° C. | 40° C. | 4° C. | 40° C. |
| No NaCl, 0.2% MP | 12410 | <LOD | 99.65 | 0 | 0.35 | 100 |
| 50 mM NaCl, 0.2% MP | 12470 | 2990 | 99.22 | 2.86 | 0.78 | 97.14 |
| 100 mM NaCl, 0.2% MP | 12380 | 3530 | 100 | 13.32 | 0 | 86.68 |
| 150 mM NaCl, 0.2% MP | 13510 | 6200 | 100 | 26.31 | 0 | 73.69 |
| 200 mM NaCl, 0.2% MP | 11250 | 6220 | 99.49 | 51.84 | 0.51 | 48.16 |
| 250 mM NaCl, 0.2% MP | 10740 | 7340 | 100 | 65.55 | 0 | 34.45 |
| No NaCl, no MP | 10430 | <LOD | 99.4 | 0 | 0.6 | 100 |
| 50 mM NaCl, no MP | 12370 | 3070 | 99.34 | 22.05 | 0.66 | 77.95 |
| 100 mM NaCl, no MP | 12580 | 9930 | 99.47 | 72.81 | 0.53 | 27.19 |
| 150 mM NaCl, no MP | 12750 | 11180 | 99.48 | 88.16 | 0.52 | 11.84 |
| 200 mM NaCl, no MP | 13660 | 13340 | 99.64 | 96.22 | 0.36 | 3.78 |
| 250 mM NaCl, no MP | 11370 | 11090 | 100 | 98.05 | 0 | 1.95 |

LOD = limit of detection

Example 14

Co-Formulations of Insulin and rHuPH20

A series of studies were performed to assess the stability of rHuPH20 and insulin under various conditions, such as various temperatures and pH, and formulations.

1. Effect of Osmolarity and pH on rHuPH20

In the first study, the effect of osmolarity and pH on the stability of rHuPH20 (formulated as Hylenex recombinant (Hyaluronidase Human Injection) was assessed by preparing formulations with varying salt concentrations and pH values, and assessing any loss of activity following storage under refrigerated (5° C.), accelerated (25° C.), and stress (25° C., 35° C. and 40° C.) conditions for up to 3 months. Hylenex recombinant (Hyaluronidase Human Injection) contains 150 U/mL rHuPH20, 144 mM NaCl, 10 mM Sodium phosphate dibasic, 1 mg/mL human albumin human, 2.7 mM Edetate disodium, 2.7 mM CaCl, and has an osmolality range of 290 to 350 mOsm and a pH of 7.4. This formulation was adjusted to prepare the 8 formulations (and control Hylenex) set forth in Table 44. The enzymatic activity (i.e. hyaluronidase activity was determined as described above. rHuPH20 content also was determined by RP-HPLC.

No meaningful changes were observed at the recommended (5° C.) or accelerated (25° C. or 30° C.) storage conditions for the four solutions prepared at the pH and osmolality specification limits or the control solution at recommended storage conditions. rHuPH20 was observed to be stable at pH 7.4 and generally more stable under acidic rather than basic conditions, as assessed by loss of enzyme activity and loss of rHuPH20 content. The effect of ionic strength was more modest. At elevated temperatures, formulations containing higher ionic strength appeared to be slightly more stable than those with lower ionic strength. There was a significant decrease in stability between 35° C. and 40° C.

TABLE 44

Formulations of rHuPH20

| Formulation (adjustment made) | NaCl mM | mg/mL | % Hylenex | Osmolarity (mOsm/kg) | pH |
|---|---|---|---|---|---|
| Plus 21% volume H₂0 | 120 | 7.0 | 83 | 267 | 7.5 |
| Plus 10% volume H₂0 | 132 | 7.7 | 91 | 290 | 7.5 |
| Plus 19 mM NaCl | 164 | 9.6 | 100 | 350 | 7.4 |
| Plus 91 mM NaCl | 236 | 13.8 | 98 | 450 | 7.3 |
| Control | 145 | 8.5 | 100 | 325 | 7.4 |
| Plus 5 mM HCl | 150 | 8.8 | 100 | 328 | 6.5 |
| Plus 8 mM HCl | 153 | 8.9 | 99 | 331 | 5.5 |
| Plus 1.9 mM NaOH | 145 | 8.5 | 100 | 324 | 8.6 |
| Plus 2.2 mM NaOH | 145 | 8.5 | 100 | 323 | 9.5 |

2. Effect of pH on rHuPH20

The effect of varying the pH of the buffer system on the stability of rHuPH20 was assessed. rHuPH20 (1,200,000 U/mL, 10 mg/mL) was formulated in 130 mM NaCl, 10 mM histidine, with a pH of 5.0, 5.5, 6.0, 6.5 or 7.0. The formulations were then stored at 5° C. for 0, 3, 6, 9 and 12 months; 25° C. in 60% relative humidity for 0, 3, 6, 9 and 12 months, and 35° C. for 0, 1, 2, 3 and 6 months. At refrigerated temperatures, all formulations were stable over all time periods. The rHuPH20 remained within trend limits for 12 months at 5° C., 6 months at 25° C., and 3 months at 35° C. for the test articles at pH 6.0, 6.5, and 7.0. The formulations prepared at pH 5.0 and 5.5 were more sensitive to elevated temperature, resulting in a significant decrease in enzymatic activity.

3. Effect of pH and Preservative on rHuPH20 Formulated with Insulin Analogs

To evaluate the impact of pH and preservative on rHuPH20 stability formulated with insulin analogs at refrigerated (5° C.), accelerated (30° C. and 35° C.), and agitation (25° C.) storage conditions for up to 4 weeks, rHuPH20 was combined with Humalog® insulin lispro or Novolog® insulin aspart and the enzymatic activity and stability assessed. The insulin stability was assessed by RP-HPLC. The test articles were prepared with 10 μg/mL rHuPH20, 100 U/mL insulin analog, 140 mM NaCl, 20 mM Tris HCl with either 0.2% phenol; 0.2% m-Cresol; 0.2% paraben; 0.2% phenol and 0.1% F68; or 0.2% phenol and 1 mM benzoate. Each of these formulations was prepared at pH 7, 7.25 and 7.5, resulting in a total of 30 test articles (15 Humalog® insulin lispro/rHuPH20 and 15 Novolog® insulin aspart/rHuPH20 test articles). The test articles were then stored at 5° C., 30° C., 35° C. and 25° C. with agitation for 4 weeks. The rHuPH20 enzymatic activity was assessed under all conditions. Insulin solubility was assessed by RP-HPLC for test articles stored at 5° C., and 25° C. with agitation.

It was observed that rHuPH20 activity was not affected by either preservative or pH after 4 weeks at 5° C. Under agitation stress conditions (20° C.), the activity of rHuPH20 was not affected when co-formulated with Novolog® insulin aspart and any of the preservatives at any the tested pH. In contrast, in some formulations with Humalog® insulin lispro, such as when formulated with 0.02% phenol, m-cresol or phenol/benzoate, the activity of rHuPH20 after 6 hours was reduced by up to 75%, most typically as the pH increased. This loss of activity correlated with precipitation of Humalog® insulin lispro.

Table 45 sets forth the rHuPH20 activity retained in each of the test articles after incubation at 30° C. and 35° C. A slight loss of rHuPH20 activity to an average of about 85% of the original activity was observed at 30° C. A greater loss was observed at 35° C., particularly, for example, in test articles containing 0.2% m-Cresol or 0.2% paraben as the pH increased.

Novolog® insulin aspart remained stable and soluble in all formulations under all storage conditions. Although the solubility of Humalog® insulin lispro was retained at pH 7.5 after 4 weeks at 5° C., Humalog® insulin lispro precipitated at lower pH (7.0 and 7.25) at his temperature. Precipitation also was observed under agitation stress conditions after 6 hours.

TABLE 45 rHuPH20 activity remaining after 4 weeks at 30° C. and 35° C. in insulin analog/rHuPH20 formulations

| | | rHuPH20 activity remaining (%) | | | |
|---|---|---|---|---|---|
| | | 30° C. | | 35° C. | |
| Formulation | pH | Humalog® insulin lispro | Novolog® insulin aspart | Humalog® insulin lispro | Novolog® insulin aspart |
| Phenol | 7.0 | 92 | 92 | 77 | 74 |
| | 7.25 | 89 | 92 | 71 | 69 |
| | 7.5 | 91 | 92 | 69 | 60 |
| m-Cresol | 7.0 | 82 | 78 | 40 | 29 |
| | 7.25 | 85 | 81 | 29 | 21 |
| | 7.5 | 77 | 71 | 11 | 9 |
| Paraben | 7.0 | 90 | 89 | 29 | 34 |
| | 7.25 | 90 | 89 | 20 | 22 |
| | 7.5 | 81 | 79 | 8 | 10 |
| Phenol/F68 | 7.0 | 93 | 94 | 81 | 68 |
| | 7.25 | 91 | 92 | 75 | 61 |
| | 7.5 | 90 | 73 | 63 | 13 |
| Phenol/benzoate | 7.0 | 90 | 88 | 73 | 67 |
| | 7.25 | 91 | 87 | 71 | 63 |
| | 7.5 | 88 | 86 | 64 | 58 |

Since modifications will be apparent to those of skill in this art, it is intended that this invention be limited only by the scope of the appended claims.

SEQUENCE LISTING (273 sequences)

SEQ ID NO: 1 - protein, 509 aa, Homo sapiens
  precursor human PH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 474 aa, Homo sapiens
  Mature PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 3 - protein, 482 aa, Homo sapiens
  precursor soluble rHuPH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 4 - protein, 447 aa, Homo sapiens [sequence omitted]

SEQ ID NO: 5 - protein, 446 aa, Homo sapiens
  soluble rHuPH20 1-446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 6 - protein, 445 aa, Homo sapiens
  soluble rHuPH20 1-445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 7 - protein, 444 aa, Homo sapiens
  soluble rHuPH20 1-444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 8 - protein, 443 aa, Homo sapiens
  soluble rHuPH20 1-443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 9 - protein, 442 aa, Homo sapiens
  soluble rHuPH20 1-442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 10 - protein, 450 aa, Bos taurus
  hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 11 - protein, 553 aa, Bos taurus
  PH20
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 12 - protein, 331 aa, Vespula vulgaris
  hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 13 - protein, 340 aa, Vespula vulgaris
  hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 14 - protein, 382 aa, Apis mellifera
  hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 15 - protein, 331 aa, Dolichovespula maculata
  hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 16 - protein, 367 aa, Polistes annularis
  hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 17 - protein, 462 aa, Mus musculus
  hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 18 - protein, 473 aa, Mus musculus
  Hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 19 - protein, 412 aa, Mus musculus
  hyalurinidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 20 - protein, 435 aa, Sus scrofa
  hyalauronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 21 - protein, 419 aa, Sus scrofa
  hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 22 - protein, 449 aa, Rattus norvegicus
  hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 23 - protein, 473 aa, Rattus norvegicus
  hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 24 - protein, 412 aa, Rattus norvegicus
  hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 25 - protein, 545 aa, Oryctolagus cuniculus
  PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 26 - protein, 476 aa, Ovis aries
  hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 27 - protein, 114 aa, Ovis aries
  PH20 partial sequence
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 28 - protein, 414 aa, Pongo pygmaeus
  hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 29 - protein, 510 aa, Macaca fascicularis
  PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 30 - protein, 529 aa, Cavia porcellus
  PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 31 - protein, 512 aa, Rattus norvegicus
  PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 32 - protein, 512 aa, Mus musculus
  PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 33 - protein, 807 aa, Staphylococcus aureus
  hyaluronidase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34 - protein, 371 aa, Streptococcus pyogenes
  bacteriophage H4489A hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 35 - protein, 1628 aa, Clostridium perfringens
  hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 36 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 37 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 38 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39 - protein, 481 aa, Homo sapiens
  Hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 40 - protein, 467 aa, Homo sapiens
  sHuPH20 precursor 1-467
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 41 - protein, 477 aa, Homo sapiens
  sHuPH20 precursor 1-477
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 42 - protein, 478 aa, Homo sapiens
  sHuPH20 precursor 1-478
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 43 - protein, 479 aa, Homo sapiens
  sHuPH20 precursor 1-479
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 44 - protein, 480 aa, Homo sapiens
  sHuPH20 precursor 1-480
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 45 - protein, 481 aa, Homo sapiens
  sHuPH20 precursor 1-481
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 46 - protein, 483 aa, Homo sapiens
  sHuPH20 precursor 1-483
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 47 - protein, 432 aa, Homo sapiens
  sHuPH20 mature 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 48 - protein, 448 aa, Homo sapiens
  sHuPH20 mature 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 49 - DNA, 1446 bp, Homo sapiens
  DNA encoding soluble rHuPH20 "precursor"
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 50 - protein, 509 aa, Homo sapiens
  PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 51 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 52 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 53 - protein, 186 aa, Mus musculus
  dihydrofolate reductase
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 54 - protein, 6 aa, Artificial Sequence
  His tag
HHHHHH

SEQ ID NO: 55 - protein, 8 aa, Artificial Sequence
  Flag tag
DYKDDDDK

SEQ ID NO: 56 - DNA, 1449 bp, Homo sapiens
  Gen2 mRNA sequence
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 57 - protein, 17 aa, Homo sapiens
  C-terminal peptide cleaved from soluble rHuPH20 aa 431-447
DAFKLPPMETEEPQIFY

SEQ ID NO: 58 - protein, 16 aa, Homo sapiens
  C-terminal peptide cleaved from soluble rHuPH20 aa 431-446
DAFKLPPMETEEPQIF

SEQ ID NO: 59 - protein, 15 aa, Homo sapiens
  C-terminal peptide cleaved from soluble rHuPH20 aa 431-445
DAFKLPPMETEEPQI

SEQ ID NO: 60 - protein, 14 aa, Homo sapiens
  C-terminal peptide cleaved from soluble rHuPH20 aa 431-444
DAFKLPPMETEEPQ

SEQ ID NO: 61 - protein, 13 aa, Homo sapiens
  C-terminal peptide cleaved from soluble rHuPH20 aa 431-443
DAFKLPPMETEEP

SEQ ID NO: 62 - protein, 12 aa, Homo sapiens
  C-terminal peptide cleaved from soluble rHuPH20 aa 431-442
DAFKLPPMETEE

SEQ ID NO: 63 - protein, 520 aa, Ovis aries
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 64 - protein, 474 aa, Bos taurus
  PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 65 - protein, 517 aa, Ovis aries
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 66 - DNA, 1620 bp, Ovis aries
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 67 - protein, 793 aa, Arthrobacter species
  (strain FB24) hyaluronan lyase
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 68 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 69 - protein, 813 aa, Propionibacterium acnes
  hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 70 - protein, 1072 aa, Streptococcus agalactiae
  hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 71 - protein, 1072 aa, Streptococcus agalactiae
  18RS21 hyaluronan lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 72 - protein, 1081 aa, Streptococcus agalactiae
  serotype Ia hyaluronan lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 73 - protein, 984 aa, Streptococcus agalactiae
  serotype III hyaluronan lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 74 - protein, 807 aa, Staphylococcus aureus; identical to SEQ ID NO: 33
  (strain COL) hyaluronan lyase

SEQ ID NO: 75 - protein, 420 aa, Staphylococcus aureus
  (strain MRSA252) hyaluronan lyase
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 76 - protein, 806 aa, Staphylococcus aureus
  (strain MRSA252) hyaluronan lyase
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 77 - protein, 815 aa, Staphylococcus aureus
  (strain MSSA476) hyaluronan lyase
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 78 - protein, 807 aa, Staphylococcus aureus; identical to SEQ ID NO: 33
  (strain NCTC 8325) hyaluronan lyase

SEQ ID NO: 79 - protein, 809 aa, Staphylococcus aureus
  (strain bovine RF122) hyaluronan lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 80 - protein, 807 aa, Staphylococcus aureus
  (strain bovine RF122) hyaluronan lyase
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 81 - protein, 807 aa, Staphylococcus aureus; identical to SEQ ID NO: 33
  (strain USA300) hyaluronan lyase

SEQ ID NO: 82 - protein, 1066 aa, Streptococcus pneumoniae
  hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 83 - protein, 1078 aa, Streptococcus pneumoniae
  (strain ATCC BAA-255/R6) hyaluronan lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 84 - protein, 1067 aa, Streptococcus pneumoniae
  serotype 2 (strain D39/NCTC 7466) hyaluronan lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 85 - protein, 805 aa, Streptococcus pyogenes
  serotype M1 hyaluronan lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 86 - protein, 780 aa, Streptococcus pyogenes
  serotype M2 (strain MGAS10270) hyaluronan lyase
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 87 - protein, 868 aa, Streptococcus pyogenes
  serotype M4 (strain MGAS10750) hyaluronan lyase
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 88 - protein, 828 aa, Streptococcus pyogenes
  serotype M6 hyaluronan lyase
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 89 - protein, 556 aa, Streptococcus pyogenes
  serotype M12 (strain MGAS2096) hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 90 - protein, 635 aa, Streptococcus pyogenes
  serotype M12 (strain MGAS2096) hyaluronan lyase
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 91 - protein, 828 aa, Streptococcus pyogenes
  serotype M12 (strain MGAS9429) hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 92 - protein, 828 aa, Streptococcus pyogenes
  serotype M28 hyaluronan lyase
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 93 - protein, 522 aa, Streptococcus suis
  hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 94 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 95 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 96 - protein, 802 aa, Vibrio fischeri
  (strain ATCC 700601 / ES114) hyaluronan lyase
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 97 - protein, 517 aa, Synechococcus species
  (strain RCC307) hyaluronan lyase
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 98 - protein, 1021 aa, Proteus vulgaris
  chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 99 - protein, 700 aa, Pedobacter heparinus
  chondroitin AC lyase
MKKLFVTCIVFFSILSPALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 100 - protein, 844 aa, Victivallis vadensis
  ATCC BAA-548 chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 101 - protein, 110 aa, Homo sapiens
  Preproinsulin
  SIGNAL (1)...(24): Signal sequence
  CHAIN (25)...(54): Insulin B Chain
  PROPEP (57)...(87): Insulin C peptide
  CHAIN (90)...(110): Insulin A chain
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 102 - protein, 86 aa, Homo sapiens
  Proinsulin
  CHAIN (66)...(86): Insulin A Chain
  PROPEP (33)...(63): Insulin C peptide
  CHAIN (1)...(30): Insulin B chain
FVNQHLCGSHLVEALYLVCGERGFFYTPKTRREAEDLQVGQVELGGGPGAGSLQPLALEGSLQKRGIVEQCCTSICSLYQLENYCN

SEQ ID NO: 103 - protein, 21 aa, Homo sapiens
  Insulin A chain
GIVEQCCTSICSLYQLENYCN

SEQ ID NO: 104 - protein, 30 aa, Homo sapiens
  Insulin B chain
FVNQHLCGSHLVEALYLVCGERGFFYTPKT

SEQ ID NO: 105 - protein, 110 aa, Gorilla gorilla; identical to SEQ ID NO: 101
  Preproinsulin
  CHAIN (66)...(86): Insulin B Chain
  CHAIN (1)...(30): Insulin A chain

SEQ ID NO: 106 - protein, 110 aa, Pongo pygmaeus
  Preproinsulin
MALWMRLLPLLALLALWGPDPAQAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 107 - protein, 110 aa, Pan troglodytes
  Preproinsulin
MALWMRLLPLLVLLALWGPDPASAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 108 - protein, 110 aa, Macaca fascicularis
  Preproinsulin
MALWMRLLPLLALLALWGPDPAPAFVNQHLCGSHLVEALYLVCGERGFFYTPKTRREAEDPQVGQVELGGGPGAGSLQPLALEGSLQKRGIVEQCCTSICSLYQLENYCN

SEQ ID NO: 109 - protein, 110 aa, Cercopithecus aethiops
  Preproinsulin
MALWMRLLPLLALLALWGPDPVPAFVNQHLCGSHLVEALYLVCGERGFFYTPKTRREAEDPQVGQVELGGGPGAGSLQPLALEGSLQKRGIVEQCCTSICSLYQLENYCN

SEQ ID NO: 110 - protein, 110 aa, Canis familiaris
  Preproinsulin
MALWMRLLPLLALLALWAPAPTRAFVNQHLCGSHLVEALYLVCGERGFFYTPKARREVEDLQVRDVELAGAPGEGGLQPLALEGALQKRGIVEQCCTSICSLYQLENYCN

SEQ ID NO: 111 - protein, 110 aa, Spermophilus tridecemlineatus
  Preproinsulin
MALWTRLLPLLALLALLGPDPAQAFVNQHLCGSHLVEALYLVCGERGFFYTPKSRREVEEQQGGQVELGGGPGAGLPQPLALEMALQKRGIVEQCCTSICSLYQLENYCN

SEQ ID NO: 112 - protein, 110 aa, Volemys kikuchii
  Preproinsulin
MALWMRLLPLLALLVLWEPNPAQAFVNQHLCGSHLVEALYLVCGERGFFYTPKSRRGVEDPQVAQLELGGGPGAGDLQTLALEVAQQKRGIVDQCCTSICSLYQLENYCN

SEQ ID NO: 113 - protein, 108 aa, Aotus trivirgatus
  Preproinsulin
MALWMHLLPLLALLALWGPEPAPAFVNQHLCGPHLVEALYLVCGERGFFYAPKTRREAEDLQVGQVELGGGSITGSLPPLEGPMQKRGVVDQCCTSICSLYQLQNYCN

SEQ ID NO: 114 - protein, 110 aa, Apodemus semotus
  Preproinsulin 1
MALCVRFLSLLILLILWEPNPAQAFVKQHLCGPHLVEALYLVCGERGFFYTPKSRREVEDPQVEQLELGGAPGTGDLETLALEVARQKRGIVDQCCTSICSLYQLENYCN

SEQ ID NO: 115 - protein, 110 aa, Apodemus semotus
  Preproinsulin 2
MALWMRFLPLLVLLFLWEPNPAQAFVKQHLCGSHLVEALYLVCGERGFFYTPMSRREVEDPQVAQLELGGGPGAGDLQTLALEVARQKRGIVDQCCTSICSLYQLENYCN

SEQ ID NO: 116 - protein, 110 aa, Cricetulus longicaudatus
  Preproinsulin
MTLWMRLLPLLTLLVLWEPNPAQAFVNQHLCGSHLVEALYLVCGERGFFYTPKSRRGVEDPQVAQLELGGGPGADDLQTLALEVAQQKRGIVDQCCTSICSLYQLENYCN

SEQ ID NO: 117 - protein, 110 aa, Rattus norvegicus
  Preproinsulin 1
MALWMRFLPLLALLVLWEPKPAQAFVKQHLCGPHLVEALYLVCGERGFFYTPKSRREVEDPQVPQLELGGGPEAGDLQTLALEVARQKRGIVDQCCTSICSLYQLENYCN

SEQ ID NO: 118 - protein, 110 aa, Rattus norvegicus
  Preproinsulin 2
MALWIRFLPLLALLILWEPRPAQAFVKQHLCGSHLVEALYLVCGERGFFYTPMSRREVEDPQVAQLELGGGPGAGDLQTLALEVARQKRGIVDQCCTSICSLYQLENYCN

SEQ ID NO: 119 - protein, 110 aa, Rattus losea
  Preproinsulin 1
MALWMRFLPLLALLVVWEPKPAQAFVKQHLCGPHLVEALYLVCGERGFFYTPKSRREVEDPQVPQLELGGSPEAGDLQTLALEVARQKRGIVDQCCTSICSLYQLENYCN

SEQ ID NO: 120 - protein, 110 aa, Rattus losea
  Preproinsulin 2
MALWIRFLPLLALLVLWEPRPAQAFVKQHLCGSHLVEALYLVCGERGFFYTPVSRREVEDPQVAQQELGGGPGAGDLQTLALEVARQKRGIVDQCCTSICSLYQLENYCN

SEQ ID NO: 121 - protein, 110 aa, Niviventer coxingi
  Preproinsulin 1
MALWMRFLPLLALLVLWEPNPAQAFVKQHLCGPHLVEALYLVCGERGFFYTPKSRREVEDPQVAQLELGEGPEAGDLQTLALEVARQKRGIVDQCCTSICSLYQLENYCN

SEQ ID NO: 122 - protein, 110 aa, Niviventer coxingi
  Preproinsulin 2
MALWIRFLPLLALLVLWEPHPAQAFVKQHLCGSHLVEALYLVCGERGFFYTPMSRREVEDPQVPQLELGGGPGTGDLQTLALEVARQKRGIVDQCCTSICSLYQLENYCN

SEQ ID NO: 123 - protein, 108 aa, Sus scrofa
  Preproinsulin
MALWTRLLPLLALLALWAPAPAQAFVNQHLCGSHLVEALYLVCGERGFFYTPKARREAENPQAGAVELGGGLGGLQALALEGPPQKRGIVEQCCTSICSLYQLENYCN

SEQ ID NO: 124 - protein, 110 aa, Meriones unguiculatus
  Preproinsulin
MALWMRLLPLLAFLILWEPTPAHAFVNQHLCGSHLVEALYLVCGERGFFYTPKFRRGVEDPQMPQLELGGSPGAGDLQALALEVARQKRGIVEQCCTGICSLYQLENYCN

SEQ ID NO: 125 - protein, 110 aa, Oryctolagus cuniculus
  Preproinsulin
MASLAALLPLLALLVLCRLDPAQAFVNQHLCGSHLVEALYLVCGERGFFYTPKSRREVEELQVGQAELGGGPGAGGLQPSALELALQKRGIVEQCCTSICSLYQLENYCN

SEQ ID NO: 126 - protein, 108 aa, Mus musculus
  Preproinsulin 1
MALLVHFLPLLALLALWEPKPTQAFVKQHLCGPHLVEALYLVCGERGFFYTPKSRREVEDPQVEQLELGGSPGDLQTLALEVARQKRGIVDQCCTSICSLYQLENYCN

SEQ ID NO: 127 - protein, 110 aa, Mus musculus
  Preproinsulin 2
MALWMRFLPLLALLFLWESHPTQAFVKQHLCGSHLVEALYLVCGERGFFYTPMSRREVEDPQVAQLELGGGPGAGDLQTLALEVAQQKRGIVDQCCTSICSLYQLENYCN

SEQ ID NO: 128 - protein, 110 aa, Mus spretus; identical to SEQ ID NO: 127
  Preproinsulin 2

SEQ ID NO: 129 - protein, 108 aa, Mus caroli
  Preproinsulin 1
MALLVRFLPLLALLALWEPKPTQAFVKQHLCGPHLVEALYLVCGERGFFYSPKSRREVEDPQVEQLELGGSPGDLQTLALEVAREKRGIVDQCCTSICSLYQLENYCN

SEQ ID NO: 130 - protein, 110 aa, Mus caroli
  Preproinsulin 2
MALWMRFLPLVALLFLWESHPTQAFVKQHLCGSHLVEALYLVCGERGFFYTPMSRREVEDPQVAQLELGGGPGAGDLQTLALEVAQQKRGIVDQCCTSICSLYQLENYCN

SEQ ID NO: 131 - protein, 110 aa, Psammomys obesus
  Preproinsulin
MALWMRLLPLLAFLILWEPSPAHAFVNQHLCGSHLVEALYLVCGERGFFYTPKFRRGVDDPQMPQLELGGSPGAGDLRALALEVARQKRGIVEQCCTGICSLYQLENYCN

SEQ ID NO: 132 - protein, 110 aa, Felis silvestris catus
  Preproinsulin
MAPWTRLLPLLALLSLWIPAPTRAFVNQHLCGSHLVEALYLVCGERGFFYTPKARREAEDLQGKDAELGEAPGAGGLQPSALEAPLQKRGIVEQCCASVCSLYQLEHYCN

SEQ ID NO: 133 - protein, 105 aa, Bos taurus
  Preproinsulin
MALWTRLRPLLALLALWPPPPARAFVNQHLCGSHLVEALYLVCGERGFFYTPKARREVEGPQVGALELAGGPGAGGLEGPPQKRGIVEQCCASVCSLYQLENYCN

SEQ ID NO: 134 - protein, 105 aa, Ovis aries
  Preproinsulin
MALWTRLVPLLALLALWAPAPAHAFVNQHLCGSHLVEALYLVCGERGFFYTPKARREVEGPQVGALELAGGPGAGGLEGPPQKRGIVEQCCAGVCSLYQLENYCN

SEQ ID NO: 135 - protein, 110 aa, Cavia porcellus
  Preproinsulin
MALWMHLLTVLALLALWGPNTGQAFVSRHLCGSNLVETLYSVCQDDGFFYIPKDRRELEDPQVEQTELGMGLGAGGLQPLALEMALQKRGIVDQCCTGTCTRHQLQSYCN

SEQ ID NO: 136 - protein, 86 aa, Equus caballus
  Proinsulin
  UNSURE 31: Xaa=Basic residue assumed by homology
  UNSURE 32: Xaa=Basic residue assumed by homology
  UNSURE 64: Xaa=Basic residue assumed by homology
  UNSURE 65: Xaa=Basic residue assumed by homology
FVNQHLCGSHLVEALYLVCGERGFFYTPKAXXEAEDPQVGEVELGGGPGLGGLQPLALAGPQQXXGIVEQCCTGICSLYQLENYCN

SEQ ID NO: 137 - protein, 109 aa, Octodon degus
  Preproinsulin
MAPWMHLLTVLALLALWGPNSVQAYSSQHLCGSNLVEALYMTCGRSGFYRPHDRRELEDLQVEQAELGLEAGGLQPSALEMILQKRGIVDQCCNNICTFNQLQNYCNVP

SEQ ID NO: 138 - protein, 86 aa, Chinchilla brevicaudata
  Proinsulin
  UNSURE 31: Xaa=Basic residue assumed by homology
  UNSURE 32: Xaa=Basic residue assumed by homology
  UNSURE 64: Xaa=Basic residue assumed by homology
  UNSURE 65: Xaa=Basic residue assumed by homology
FVNKHLCGSHLVDALYLVCGDRGFFYTPMAXXELEDPQVGQADPGVVPEAGRLQPLALEMTLQXXGIVDQCCTSICTLYQLENYCN

SEQ ID NO: 139 - protein, 107 aa, Gallus gallus
  Preproinsulin
MALWIRSLPLLALLVFSGPGTSYAAANQHLCGSHLVEALYLVCGERGFFYSPKARRDVEQPLVSSPLRGEAGVLPFQQEEYEKVKRGIVEQCCHNTCSLYQLENYCN

SEQ ID NO: 140 - protein, 103 aa, Selasphorus rufus
  Proinsulin
IQSLPLLALLALSGPGTSHAAVNQHLCGSHLVEALYLVCGERGFFYSPKARRDAEHPLVNGPLHGEVGDLPFQQEEFEKVKRGIVEQCCHNTCSLYQLENYCN

SEQ ID NO: 141 - protein, 106 aa, Xenopus laevis
  Preproinsulin 1
MALWMQCLPLVLVLFFSTPNTEALVNQHLCGSHLVEALYLVCGDRGFFYYPKVKRDMEQALVSGPQDNELDGMQLQPQEYQKMKRGIVEQCCHSTCSLFQLESYCN

SEQ ID NO: 142 - protein, 106 aa, Xenopus laevis
  Preproinsulin 2
MALWMQCLPLVLVLLFSTPNTEALANQHLCGSHLVEALYLVCGDRGFFYYPKIKRDIEQAQVNGPQDNELDGMQFQPQEYQKMKRGIVEQCCHSTCSLFQLENYCN

SEQ ID NO: 143 - protein, 106 aa, Xenopus tropicalis
  Preproinsulin
MALWMQCLPLVLVLLFSTPNTEALANQHLCGSHLVEALYLVCGDRGFFYYPKIKRDIEQAMVNGPQDNELDGMQLQPQEYQKMKRGIVEQCCHSTCSLFQLESYCN

SEQ ID NO: 144 - protein, 106 aa, Rana pipiens
  Preproinsulin
MALWIQCLHIAVLLSLFTPTLKTFDNQYLCGSHLVEALYMVCGDRGFFYSPRSRRDLEQPLVNGLQGSELDEMQVQSQAFQKRKPGIVEQCCHNTCSLYDLENYCN

SEQ ID NO: 145 - protein, 81 aa, Anas platyrhynchos
  Preproinsulin
  UNSURE 31: Xaa=Basic residue assumed by homology
  UNSURE 32: Xaa=Basic residue assumed by homology
  UNSURE 59: Xaa=Basic residue assumed by homology
  UNSURE 60: Xaa=Basic residue assumed by homology
AANQHLCGSHLVEALYLVCGERGFFYSPKTXXDVEQPLVNGPLHGEVGELPFQHEEYQXXGIVEQCCENPCSLYQLENYCN

SEQ ID NO: 146 - protein, 51 aa, Capra hircus
  Preproinsulin
FVNQHLCGSHLVEALYLVCGERGFFYTPKAGIVEQCCAGVCSLYQLENYCN

SEQ ID NO: 147 - protein, 30 aa, Homo sapiens
  Aspart insulin
  Insulin B chain analog
FVNQHLCGSHLVEALYLVCGERGFFYTDKT

SEQ ID NO: 148 - protein, 30 aa, Homo sapiens
  Lispro insulin
  Insulin B chain analog
FVNQHLCGSHLVEALYLVCGERGFFYTKPT

SEQ ID NO: 149 - protein, 30 aa, Homo sapiens
  Glulisine insulin
  Insulin B chain analog
FVKQHLCGSHLVEALYLVCGERGFFYTPET

SEQ ID NO: 150 - protein, 21 aa, Homo sapiens
  Glargine insulin
  Insulin A chain analog
GIVEQCCTSICSLYQLENYCG

SEQ ID NO: 151 - protein, 32 aa, Homo sapiens
  Glargine insulin
  Insulin B chain analog
FVNQHLCGSHLVEALYLVCGERGFFYTPKTRR

SEQ ID NO: 152 - protein, 53 aa, Homo sapiens
  Detemir insulin
  Proinsulin analog
  CHAIN (33)...(53): A Chain
  CHAIN (1)...(29): B chain
FVNQHLCGSHLVEALYLVCGERGFFYTPKAAKGIVEQCCTSICSLYQLENYCN

SEQ ID NO: 153 - protein, 30 aa, Homo sapiens
  Insulin B chain analog
  VARIANT 28: Xaa=Pro, Lys, Leu, Val or Ala
  VARIANT 29: Xaa=Lys or Pro
FVNQHLCGSHLVEALYLVCGERGFFYTXXT

SEQ ID NO: 154 - protein, 27 aa, Homo sapiens
  Insulin B chain analog (des 28-30)
FVNQHLCGSHLVEALYLVCGERGFFYT

SEQ ID NO: 155 - protein, 29 aa, Homo sapiens
  Insulin B chain analog (des 27)
FVNQHLCGSHLVEALYLVCGERGFFYPKT

SEQ ID NO: 156 - protein, 21 aa, Homo sapiens
  Insulin A chain analog
  VARIANT 21: Xaa=Ala, Asn, Asp, Gln, Glu, Gly, Thr or Ser
GIVEQCCTSICSLYQLENYCX

SEQ ID NO: 157 - protein, 32 aa, Homo sapiens
  Insulin B chain analog
  VARIANT 1: Xaa=Phe, Asp or none
  VARIANT 2: Xaa=Val or none
  VARIANT 3: Xaa=Asn or Asp
  VARIANT 9: Xaa=Ser or Asp
  VARIANT 10: Xaa=His or Asp
  VARIANT 28: Xaa=any amino acid
  VARIANT 29: Xaa=L-Pro, D-Pro, D-hydroxypro, L-hydroxypro, L-(N-methyllysine), D-Lysine, L-(N-methyl arginine) or D-arginine
  VARIANT 30: Xaa=Ala or Thr
  VARIANT 31, 32: Xaa=Arg, Lys or none
XXXQHLCGXXLVEALYLVCGERGFFYTXXXXX

SEQ ID NO: 158 - protein, 21 aa, Homo sapiens
  Insulin A chain analog
  VARIANT 8: Xaa=His, Phe, Gly,  Gln, Glu, Ser, Asn, Asp, or Pro
  VARIANT 9: Xaa=Gly, Asp, Glu, Thr, His, Gln, Asn, Ala or Pro
  VARIANT 10: Xaa=Leu, Pro, Val, His, Ala, Glu, Asp, Thr, Gln or Asn
  VARIANT 13: Xaa=Pro, Val, Arg, His, Ala, Glu, Asp, Thr, Gly, Gln or Asn
  VARIANT 21: Xaa=Asp or Glu
GIVEQCCXXXCSXYQLENYCX

SEQ ID NO: 159 - protein, 30 aa, Homo sapiens
  Insulin B chain analog
  VARIANT 1: Xaa=Phe, Glu, Asp, Thr or Ser
  VARIANT 2: Xaa=Val, Arg, His, Ala, Glu, Asp, Thr, Pro, Gly, Gln, Ser or Asn
  VARIANT 5: Xaa=His, Ala, Glu, Aps, Thr, Ser, Gln, or Asn
  VARIANT 9: Xaa=Ser, Leu, Asp, Pro, Glu, Ile, Val, His, Thr, Gln, Asn, Met, Tyr, Trp or Phe
  VARIANT 10: Xaa=His, Asn, Leu, Asp, Arg, Glu, Ser, Thr, Ile or Gln
  VARIANT 12: Xaa=Val, Asn, His, Ile or Tyr
  VARIANT 14: Xaa=Ala, Glu,  Asp, Asn, Gln, Ser, Thr, Gly
  VARIANT 16: Xaa=Tyr, Asp, Glu, Gln, Asn, Ser, Thr, His or Arg
  VARIANT 17: Xaa=Leu, Ser, Thr, Asn, Gln, Glu, Asp or His
  VARIANT 18: Xaa=Val, Ser, Thr, Asn, Gln or His
  VARIANT 20: Xaa=Gly, Gln, Ser, Thr, Asn, Asp, Glu, His or Arg
  VARIANT 26: Xaa=Tyr, Ala, Asp, His or Glu
  VARIANT 27: Xaa=Thr, Asp, His or Glu
  VARIANT 28: Xaa=Pro, Asp or Glu
XXNQXLCGXXLXEXLXXXCXERGFFXXXKT

SEQ ID NO: 160 - protein, 21 aa, Homo sapiens
  Insulin A chain analog
  VARIANT 21: Xaa=Asn, Gly, Ala, Val, Leu, Ile, Pro, Phe, Trp, Met, Ser, Thr, Cys, Tyr, Asp or Glu
GIVEQCCTSICSLYQLENYCX

SEQ ID NO: 161 - protein, 30 aa, Homo sapiens
  Insulin B chain analog
  VARIANT 1: Xaa=Phe or none
  VARIANT 29: Xaa=Lys, Ala, Thr or Ser
  VARIANT 30: Xaa=Thr, Arg, Lys, Hyl, Orn or Cit
XVNQHLCGSHLVEALYLVCGERGFFYTPXX

SEQ ID NO: 162 - protein, 21 aa, Homo sapiens
  Insulin A chain analog
  VARIANT 21: Xaa=Asn, Gly, Ala, Val, Leu, Ile, Pro, Phe, Trp, Met, Ser, Thr, Cys, Tyr, Asp, Glu, His or Gln
GIVEQCCTSICSLYQLENYCX

SEQ ID NO: 163 - protein, 30 aa, Homo sapiens
  Insulin B chain analog
  VARIANT 1: Xaa=Phe or none
  VARIANT 3: Xaa=Asn, Gly, Ala, Val, Leu, Ile, Pro, Phe, Trp, Met, Ser, Thr, Cys, Tyr, Asp, Glu, His or Gln
  VARIANT 30: Xaa=Asn, Gly, Ala, Val, Leu, Ile, Pro, Phe, Trp, Met, Ser, Thr, Cys, Tyr, Asp, Glu, His or Gln
XVXQHLCGSHLVEALYLVCGERGFFYTPKX

SEQ ID NO: 164 - protein, 21 aa, Homo sapiens
  Insulin A chain analog
  VARIANT 8: Xaa=Ala or Thr
  VARIANT 10: Xaa=Val or Ile
  VARIANT 21: Xaa=Asn, Asp, Gly, Ser, Thr or Ala
GIVEQCCXSXCSLYQLENYCX

SEQ ID NO: 165 - protein, 30 aa, Homo sapiens
  Insulin B chain analog
  VARIANT 1: Xaa=Phe or none
  VARIANT 30: Xaa=Thr or none
XVNQHLCGSHLVEALYLVCGERGFFYTPKX

SEQ ID NO: 166 - protein, 6 aa, Artificial Sequence
  Linker Peptide Sequence
RPPPPC

SEQ ID NO: 167 - protein, 7 aa, Artificial Sequence
  Linker Peptide Sequence
SSPPPPC

SEQ ID NO: 168 - protein, 5 aa, Artificial Sequence
  Linker Peptide Sequence
GGGGS

SEQ ID NO: 169 - protein, 5 aa, Artificial Sequence
  Linker Peptide Sequence
  REPEAT (1)...(5): Repeating linker peptide
GGGGS

SEQ ID NO: 170 - protein, 12 aa, Artificial Sequence
  Linker Peptide Sequence
GKSSGSGSESKS

SEQ ID NO: 171 - protein, 14 aa, Artificial Sequence
  Linker Peptide Sequence
GSTSGSGKSSEGKG

SEQ ID NO: 172 - protein, 18 aa, Artificial Sequence
  Linker Peptide Sequence
GSTSGSGKSSEGSGSTKG

SEQ ID NO: 173 - protein, 14 aa, Artificial Sequence
  Linker Peptide Sequence
GSTSGSGKSSEGKG

SEQ ID NO: 174 - protein, 18 aa, Artificial Sequence
  Linker Peptide Sequence
GSTSGSGKPGSGEGSTKG

SEQ ID NO: 175 - protein, 14 aa, Artificial Sequence
  Linker Peptide Sequence
EGKSSGSGSESKEF

SEQ ID NO: 176 - protein, 5 aa, Artificial Sequence
  Linker Peptide Sequence
SRSSG

SEQ ID NO: 177 - protein, 5 aa, Artificial Sequence
  Linker Peptide Sequence
SGSSC

SEQ ID NO: 178 - protein, 3 aa, Artificial Sequence
  Linker Peptide Sequence
AAK

SEQ ID NO: 179 - protein, 2 aa, Artificial Sequence
  Linker Peptide Sequence
VM

SEQ ID NO: 180 - protein, 2 aa, Artificial Sequence
  Linker Peptide Sequence
AM

SEQ ID NO: 181 - protein, 59 aa, Artificial Sequence
  Linker Peptide Sequence
  REPEAT (3)...(57): 1, 2, 3, 4, 5, 6, 7, 8, 9 or 10 of the Gly Gly Xaa Xaa Ser repeats may be absent
  VARIANT 5, 6, 10, 11, 15, 16, 20, 21, 25, 26, 30, 31, 35, 36, 40,41, 45, 46, 50, 51, 55, 56: Xaa=Gly or none
AMGGXXSGGXXSGGXXSGGXXSGGXXSGGXXSGGXXSGGXXSGGXXSGGXXSGGXXSAM

SEQ ID NO: 182 - protein, 30 aa, Homo sapiens
  HMR-1 153 B-chain
FVKQHLCGSHLVEALYLVCGERGFFYTIKT

SEQ ID NO: 183 - protein, 21 aa, Homo sapiens
  HMR-1 1423 A-chain
GIVEQCCTSICSLYQLENYCG

SEQ ID NO: 184 - protein, 32 aa, Homo sapiens
  HMR-1 1423 B-chain
FVNQHLCGSHLVEALYLVCGERGFFYTPKTHH

SEQ ID NO: 185 - protein, 510 aa, Pan troglodytes
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 186 - protein, 512 aa, Macaca mulatta
  Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 187 - protein, 505 aa, Homo sapiens
  HuPH20 precursor 1-505
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 188 - protein, 503 aa, Homo sapiens
  HuPH20 precursor 1-503
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 189 - protein, 501 aa, Homo sapiens
  HuPH20 precursor 1-501
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 190 - protein, 499 aa, Homo sapiens
  HuPH20 precursor 1-499
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 191 - protein, 497 aa, Homo sapiens
  HuPH20 precursor 1-497
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 192 - protein, 495 aa, Homo sapiens
  HuPH20 precursor 1-495
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 193 - protein, 493 aa, Homo sapiens
  HuPH20 precursor 1-493
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 194 - protein, 491 aa, Homo sapiens
  HuPH20 precursor 1-491
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 195 - protein, 489 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 196 - protein, 490 aa, Homo sapiens
  HuPH20 precursor 1-490
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 197 - protein, 487 aa, Homo sapiens
  HuPH20 precursor 1-487
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 198 - protein, 485 aa, Homo sapiens
  HuPH20 precursor 1-485
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 199 - protein, 484 aa, Homo sapiens
  HuPH20 precursor 1-484
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 200 - protein, 476 aa, Homo sapiens
  HuPH20 precursor 1-476
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 201 - protein, 475 aa, Homo sapiens
  HuPH20 precursor 1-475
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 202 - protein, 474 aa, Homo sapiens
  HuPH20 precursor 1-474
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 203 - protein, 473 aa, Homo sapiens
  HuPH20 precursor 1-473
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 204 - protein, 472 aa, Homo sapiens
  HuPH20 precursor 1-472
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 205 - protein, 471 aa, Homo sapiens
  HuPH20 precursor 1-471
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 206 - protein, 470 aa, Homo sapiens
  HuPH20 precursor 1-470
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 207 - protein, 469 aa, Homo sapiens
  HuPH20 precursor 1-469
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 208 - protein, 468 aa, Homo sapiens
  HuPH20 precursor 1-468
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 209 - protein, 466 aa, Homo sapiens
  HuPH20 precursor 1-466
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 210 - protein, 465 aa, Homo sapiens
  HuPH20 precursor 1-465
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 211 - protein, 464 aa, Homo sapiens
  HuPH20 precursor 1-464
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 212 - protein, 462 aa, Homo sapiens
  HuPH20 precursor 1-462
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 213 - protein, 460 aa, Homo sapiens
  HuPH20 precursor 1-460
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 214 - protein, 458 aa, Homo sapiens
  HuPH20 precursor 1-458
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 215 - protein, 456 aa, Homo sapiens
  HuPH20 precursor 1-456
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 216 - protein, 454 aa, Homo sapiens
  HuPH20 precursor 1-454
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 217 - protein, 452 aa, Homo sapiens
  HuPH20 precursor 1-452
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 218 - protein, 450 aa, Homo sapiens
  HuPH20 precursor 1-450
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 219 - protein, 508 aa, Homo sapiens
  HuPH20 precursor 1-508
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 220 - protein, 506 aa, Homo sapiens
  HuPH20 precursor 1-506
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 221 - protein, 504 aa, Homo sapiens
  HuPH20 precursor 1-504
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 222 - protein, 502 aa, Homo sapiens
  HuPH20 precursor 1-502
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 223 - protein, 500 aa, Homo sapiens
  HuPH20 precursor 1-500
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 224 - protein, 498 aa, Homo sapiens
  HuPH20 precursor 1-498
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 225 - protein, 496 aa, Homo sapiens
  HuPH20 precursor 1-496
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 226 - protein, 494 aa, Homo sapiens
  HuPH20 precursor 1-494
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 227 - protein, 492 aa, Homo sapiens
  HuPH20 precursor 1-492
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 228 - protein, 488 aa, Homo sapiens
  HuPH20 precursor 1-488
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 229 - protein, 486 aa, Homo sapiens
  HuPH20 precursor 1-486
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 230 - protein, 472 aa, Homo sapiens
  mature HuPH20 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 231 - protein, 470 aa, Homo sapiens
  mature HuPH20 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 232 - protein, 468 aa, Homo sapiens
  mature HuPH20 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 233 - protein, 466 aa, Homo sapiens
  mature HuPH20 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 234 - protein, 464 aa, Homo sapiens
  mature HuPH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 235 - protein, 462 aa, Homo sapiens
  esHuPH20 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 236 - protein, 460 aa, Homo sapiens
  esHuPH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 237 - protein, 458 aa, Homo sapiens
  esHuPH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 238 - protein, 456 aa, Homo sapiens
  esHuPH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 239 - protein, 454 aa, Homo sapiens
  mature HuPH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 240 - protein, 455 aa, Homo sapiens
  mature HuPH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 241 - protein, 452 aa, Homo sapiens
  mature HuPH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 242 - protein, 450 aa, Homo sapiens
  Mature HuPH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 243 - protein, 449 aa, Homo sapiens
  Mature HuPH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 244 - protein, 441 aa, Homo sapiens
  Mature HuPH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 245 - protein, 440 aa, Homo sapiens
  Mature HuPH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 246 - protein, 439 aa, Homo sapiens
  Mature HuPH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 247 - protein, 438 aa, Homo sapiens
  Mature HuPH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 248 - protein, 437 aa, Homo sapiens
  Mature HuPH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 249 - protein, 436 aa, Homo sapiens
  Mature HuPH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 250 - protein, 435 aa, Homo sapiens
  Mature HuPH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 251 - protein, 434 aa, Homo sapiens
  Mature HuPH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 252 - protein, 433 aa, Homo sapiens
  Mature HuPH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 253 - protein, 431 aa, Homo sapiens
  Mature HuPH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 254 - protein, 430 aa, Homo sapiens
  Mature HuPH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 255 - protein, 429 aa, Homo sapiens
  Mature HuPH20 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 256 - protein, 427 aa, Homo sapiens
  Mature HuPH20 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 257 - protein, 425 aa, Homo sapiens
  Mature HuPH20 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 258 - protein, 423 aa, Homo sapiens
  Mature HuPH20 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 259 - protein, 421 aa, Homo sapiens
  Mature HuPH20 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 260 - protein, 419 aa, Homo sapiens
  Mature HuPH20 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 261 - protein, 417 aa, Homo sapiens
  Mature HuPH20 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 262 - protein, 415 aa, Homo sapiens
  Mature HuPH20 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 263 - protein, 473 aa, Homo sapiens
  Mature HuPH20 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 264 - protein, 471 aa, Homo sapiens
  Mature HuPH20 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 265 - protein, 469 aa, Homo sapiens
  Mature HuPH20 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 266 - protein, 467 aa, Homo sapiens
  Mature HuPH20 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 267 - protein, 465 aa, Homo sapiens
  Mature HuPH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 268 - protein, 463 aa, Homo sapiens
  Mature HuPH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 269 - protein, 461 aa, Homo sapiens
  esHuPH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 270 - protein, 459 aa, Homo sapiens
  esHuPH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 271 - protein, 457 aa, Homo sapiens
  esHuPH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 272 - protein, 453 aa, Homo sapiens
  Mature HuPH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 273 - protein, 451 aa, Homo sapiens
  Mature HuPH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

The invention claimed is:

1. A super fast-acting insulin composition, comprising:
a therapeutically effective amount of a fast-acting insulin analog for controlling blood glucose levels, wherein the fast-acting analog is insulin aspart or insulin glulisine; and
an amount of a hyaluronan degrading enzyme sufficient to render the composition a super fast-acting insulin composition, wherein:
the sufficient amount of a hyaluronan degrading enzyme to render the composition a super fast-acting insulin composition is 1 Unit or more hyaluronidase activity/mL;
the super fast-acting insulin composition has an onset of action that is shorter than the analog alone, and a duration of action that is shorter than the analog alone, whereby, upon administration, the composition closely mimics the physiologic post-prandial insulin response of a non-diabetic subject to achieve glycemic control; and the super fast-acting insulin composition is formulated for a route of administration selected from among subcutaneous, intradermal and intraperitoneal administration.

2. The composition of claim 1, wherein
the amount of fast-acting insulin analog is from or from about 10 U/mL to at or about 500 U/ml insulin analog; and
the sufficient amount of a hyaluronan degrading enzyme to render the composition a super fast-acting insulin composition is functionally equivalent to at least or about 1 U hyaluronidase activity/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL, 25 U /mL, 30 U/mL, 35 U/mL, 37.5 U/mL, 40 U/mL, 50 U/mL, 60 U/mL, 70 U/mL, 80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/mL, 2000 U/mL, 3000 U/mL or 5000 U/mL.

3. The composition of claim 1, wherein the sufficient amount of a hyaluronan degrading enzyme to render the composition a super fast-acting insulin composition is functionally equivalent to at least or about 30 to 35 Units hyaluronidase activity/mL.

4. The composition of claim 1, wherein the volume of the composition is at least or is about 1 mL, 3 mL, 5 mL, 10 mL, 20 mL or 50 mL; and/or
the amount of fast-acting insulin analog is or is about 10 U/mL, 20 U/mL, 30 U/mL, 40 U/mL, 50 U/mL, 60 U/mL, 70 U/mL, 80 U/mL, 90 U/mL, 100 U/mL, 150 U/mL, 200 U/mL, 250 U/mL, 300 U/mL, 350 U/mL, 400 U/mL, 450 U/mL, 500 U/ml or 500 U/mL; and/or
the amount of hyaluronan degrading enzyme is functionally equivalent to or to about at least 1 U/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL, 25 U/mL, 30 U/mL, 35 U/mL, 37.5 U/mL, 40 U/mL, 50 U/mL, 60 U/mL, 70 U/mL, 80 U/mL, 90 U/mL, 100 U/mL, 200 U/mL, 300 U/mL, 400 U/mL, 500 U/mL, 600 U/mL, 700 U/mL, 800 UlmL, 900 U/mL, 1000 U/ml, 2000 U/mL, 3000 U/mL or 5000 U/mL.

5. The composition of claim 1 that is formulated for multiple dose administration or single dose administration.

6. The composition of claim 1 that is formulated for delivery in a closed loop system, an insulin pen or an insulin pump.

7. The composition of claim 1, wherein the blood glucose levels are prandial blood glucose levels.

8. The composition of claim 1, wherein the therapeutically effective amount of insulin analog for a single dosage is or is about 0.05 Units, 0.06 Units, 0.07 Units, 0.08 Units, 0.09 Units, 0.1 Units, 0.2 Units, 0.3 Units, 0.4 Units, 0.5 Units, 0.6 Units, 0.7 Units, 0.8 Units, 0.9 Units, 1 Unit, 2 Units, 5 Units, 10 Units, 15 Units, 20 Units, 25 Units, 30 Units, 35 Units, 40 Units, 50 Units or 100 units; and/or
the amount of hyaluronan degrading enzyme for a single dosage is functionally equivalent to or to about 0.3 Units, 0.5 Units, 1 Unit, 2 Units, 5 Units, 10 Units, 20 Units, 30 Units, 40 Units, 50 Units, 100 Units, 150 Units, 200 Units, 250 Units, 300 Units, 350 Units, 400 Units, 450 Units, 500 Units, 600 Units, 700 Units, 800 Units, 900 Units, 1000 Units, 2,000 Units, 3,000 Units, 4,000 Units or more of hyaluronidase activity.

9. The composition of claim 1, further comprising a chelating agent.

10. The super fast-acting insulin composition of claim 9, wherein the chelating agent is ethylenediaminetetraacetic acid (EDTA) or ethylenediaminetetraacetate.

11. The composition of claim 9, wherein the chelating agent is provided as a complex with a metal at or about equimolar concentrations of the metal and chelating agent.

12. The composition of claim 11, wherein the chelating agent complex is calcium EDTA.

13. The composition of claim 1, further comprising an amount of zinc.

14. The composition of claim 13, containing from or from about 0.01 mg to or to about 0.02 mg zinc and from or from about 0.1 mM to or to about 50 mM calcium EDTA per 100 U fast-acting insulin analog.

15. The composition of claim 13 , comprising zinc in a molar ratio of or of about 1:3 to the fast-acting insulin analog and calcium EDTA at a molar ratio of or of about 1:3 to 10:1 to the fast-acting insulin analog.

16. The composition of claim 1, wherein the pH of the composition is from or from about 6.5 to about 7.5.

17. The composition of claim 1, further comprising a stabilizer for the fast-acting insulin analog, a stabilizer for the hyaluronan degrading enzyme or both.

18. The composition of claim 17, wherein the stabilizer is a detergent, a polyalcohol, a metal, a salt, a cosolvent and/or a protein.

19. The composition of claim 1, further comprising an oxygen scavenger.

20. The composition of claim 19, wherein the oxygen scavenger is selected from among ascorbic acid, ascorbate, citric acid, citrate, methionine and albumin.

21. The composition of claim 1, wherein the insulin analog is selected from among an insulin having an A chain with a sequence of amino acids set forth in SEQ NOS:103 and a B chain having a sequence of amino acids set forth in SEQ ID NO:147 or 149.

22. The composition of claim 1, further comprising a basal-acting insulin.

23. The composition of claim 1, wherein the hyaluronan degrading enzyme is a hyaluronidase.

24. The composition of claim 1, wherein the precursor hyaluronidase or hyaluronidase has a sequence of amino acids set forth in any of SEQ ID NOS:1-39 or 67-96, truncated forms thereof and variants thereof that have 60%, 70%, 80%, 90%, 91%, 92%, 93%, 94%, 95%, 96%, 97%, 98%, or 99% sequence identity to the polypeptide set forth in SEQ ID NO: 1 and that exhibit hyaluronidase activity.

25. The composition of claim 23, wherein the hyaluronidase is a soluble hyaluronidase.

26. The composition of claim 25, wherein the soluble hyaluronidase is a PH20, or a truncated form thereof that lacks all or a portion of a glycosylphosphatidylinositol (GPI) anchor.

27. The composition of claim 26, wherein the PH20 is selected from an ovine, bovine or truncated human PH20.

28. The composition of claim 27, wherein the truncated human PH20 is selected from among polypeptides having a sequence of amino acids set forth in any of SEQ ID NOS:4-9, and variants thereof that have 60%, 70%, 80%, 90%, 91%, 92%, 93%, 94%, 95%, 96%, 97%, 98%, or 99% sequence identity to the polypeptides set forth in any of SEQ ID NOS: 4-9, and that exhibit hyaluronidase activity.

29. The composition of claim 23, wherein the hyaluronidase is a soluble hyaluronidase provided as a composition designated rHuPH20.

30. The composition of claim 1, wherein the hyaluronan degrading enzyme is a chondroitinase.

31. The composition of claim 30, wherein the chondroitinase is selected from among the group consisting of chondroitin ABC lyase, chondroitin AC lyase and chondroitin C lyase.

32. The composition of claim 31, wherein the precursor chondroitinase or chondroitinase has a sequence of amino acids set forth in any of SEQ ID NOS: 98-100, truncated forms thereof and variants thereof that have 60%, 70%, 80%, 90%, 91%, 92%, 93%, 94%, 95%, 96%, 97%, 98%, or 99% sequence identity to the polypeptides set forth in any of SEQ ID NOS: 98-100, and that have the ability to degrade hyaluronan.

33. A syringe or vial, comprising the composition of claim 1.

34. A closed loop system, comprising the composition of claim 1.

35. An insulin pump, comprising the composition of claim 1.

36. An insulin pen, comprising the composition of claim 1.

37. A closed loop system for controlling blood glucose levels in a subject, comprising:
a fast-acting insulin analog selected from insulin aspart or insulin glulisine; and
a hyaluronan degrading enzyme, wherein:
the fast-acting insulin analog and the hyaluronan degrading enzyme are in the same or different reservoirs;
the amount of a hyaluronan degrading enzyme is sufficient, when combined with the insulin, to render the insulin a super fast-acting insulin;
the concentration of hyaluronan degrading enzyme in the closed loop system is 1 Unit or more hyaluronidase activity/mL; and
the fast-acting insulin analog and the hyaluronan degrading enzyme, when combined, form a super fast-acting insulin, which has an onset of action that is shorter than the analog alone, and a duration of action that is shorter than the analog alone, whereby, upon administration, the insulin closely mimics the physiologic post-prandial insulin response of a non-diabetic subject to achieve glycemic control.

38. The closed loop system of claim 37, further comprising one or more of a glucose sensor, a delivery system to deliver the hyaluronan degrading enzyme and fast-acting insulin analog, and software programmed to integrate the pumping and monitoring functions, whereby hyaluronan degrading enzyme and fast-acting insulin analog are delivered to achieve glycemic control that mimics the glycemic control in a non-diabetic subject.

39. The closed loop system of claim 37, wherein the insulin analog is selected from among an insulin having an A chain with a sequence of amino acids set forth in SEQ NOS:103 and a B chain having a sequence of amino acids set forth in SEQ ID NO:147 or 149.

40. The closed loop system of claim 37, further comprising a basal-acting insulin.

41. The closed loop system of claim 37, wherein the hyaluronan degrading enzyme is a hyaluronidase.

42. The closed loop system of claim 41, wherein the hyaluronidase is a soluble hyaluronidase.

43. The closed loop system of claim 42, wherein the soluble hyaluronidase is a PH20, or a truncated form thereof that lacks all or a portion of a glycosylphosphatidylinositol (GPI) anchor.

44. The closed loop system of claim 43, wherein the PH20 is selected from an ovine, bovine or truncated human PH20.

45. The closed loop system of claim 44, wherein the truncated human PH20 is selected from among polypeptides having a sequence of amino acids set forth in any of SEQ ID NOS:4-9, and variants thereof that have 60%, 70%, 80%, 90%, 91%, 92%, 93%, 94%, 95%, 96%, 97%, 98%, or 99% sequence identity to a polypeptide set forth in any of SEQ ID NOS: 4-9, and that exhibit hyaluronidase activity.

46. The closed loop system of claim 41, wherein the hyaluronidase is a soluble hyaluronidase provided as a composition designated rHuPH20.

47. The closed loop system of claim 37, wherein the hyaluronan degrading enzyme is a chondroitinase.

48. The closed loop system of claim 47, wherein the chondroitinase is selected from among the group consisting of chondroitin ABC lyase, chondroitin AC lyase and chondroitin C lyase.

49. The closed loop system of claim 48, wherein the precursor chondroitinase or chondroitinase has a sequence of amino acids set forth in any of SEQ ID NOS:98-100, truncated forms thereof and variants thereof that have 60%, 70%, 80%, 90%, 91%, 92%, 93%, 94%, 95%, 96%, 97%, 98%, or 99% sequence identity to a polypeptide set forth in any of SEQ ID NOS: 98-100, and that have the ability to degrade hyaluronan.

50. The closed loop system of claim 37, wherein the system is capable of delivering the fast-acting insulin analog in individual dose increments of from at or about 0.1 Units, 0.2 Units, 03 Units, 0.4 Units, 0.5 Units, 0.6 Units, 0.7 Units, 0.8 Units, 0.9 Units, 1 Unit, 2 Units, 5 Units, 10 Units, 15 Units, 20 Units, 25 Units, 30 Units, 35 Units, 40 Units, 50 Units or more of fast-acting insulin analog.

51. The closed loop system of claim 37, wherein the reservoir containing the hyaluronan degrading enzyme contains an amount of hyaluronan degrading enzyme that is functionally equivalent to at or about 0.3 Units, 0.5 Units, 1 Unit, 2 Units, 5 Units, 10 Units, 20 Units, 30 Units, 40 Units, 50 Units, 100 Units, 150 Units, 200 Units, 250 Units, 300 Units, 350 Units, 400 Units, 450 Units, 500 Units, 600 Units, 700 Units, 800 Units, 900 Units, 1000 Units, 2,000 Units, 3,000 Units, 4,000 Units, 5000 Units, 6,000 Units, 7,000 Units, 8,000 Units, 9,000 Units, 10,000 Units, 20,000 Units or more hyaluronidase activity.

52. The closed loop system of claim 37, wherein the system is capable of delivering the hyaluronan degrading enzyme in individual dose increments of an amount of hyaluronan degrading enzyme that is functionally equivalent to at or about 0.3 Units, 0.5 Units, 1 Unit, 2 Units, 3 Units, 5 Units, 10 Units, 20 Units, 30 Units, 40 Units, 50 Units, 100 Units, 150 Units or more of hyaluronidase activity.

53. A combination, comprising:
a first composition containing from or from about 10 Units (U) to or to about 500 U of a fast-acting insulin analog selected from insulin aspart or insulin glulisine; and
a second composition containing a sufficient amount of a hyaluronan degrading enzyme that, when administered with the insulin, renders the composition containing the fast-acting insulin analog a super fast-acting insulin composition; wherein:
the sufficient amount of hyaluronan degrading enzyme is functionally equivalent to at least or about 1 U hyaluronidase activity/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL, 25 U/mL, 30 U/mL, 35 U/mL, 37.5 U/mL, 40 U/mL, 50 U/mL, 60 U/mL, 70 U/mL, 80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/mL, 2000 U/mL, 3000 U/mL or 5000 U/mL; and
the fast-acting insulin analog and the hyaluronan degrading enzyme, when combined, form a super fast-acting insulin, which has an onset of action that is shorter than the analog alone, and a duration of action that is shorter than the analog alone, whereby, upon administration, the insulin closely mimics the physiologic post-prandial insulin response of a non-diabetic subject to achieve glycemic control.

54. The combination of claim 53, wherein the sufficient amount of hyaluronan degrading enzyme is functionally equivalent to at least or about 30 to 35 Units hyaluronidase activity/mL.

55. The combination of claim 53, wherein the amount of fast-acting insulin analog in the first composition is or is about 10 U/mL, 20 U/mL, 30 U/mL, 40 U/mL, 50 U/mL, 60 U/mL, 70 U/mL, 80 U/mL, 90 U/mL, 100 U/mL, 150 U/mL, 200 U/mL, 250 U/mL, 300 U/mL, 350 U/mL, 400 U/mL, 450 U/ml or 500 U/mL.

56. The combination of claim 53, wherein the compositions are formulated for subcutaneous administration.

57. The combination of claim 53, wherein the insulin analog is selected from among an insulin having an A chain with a sequence of amino acids set forth in SEQ NOS:103 and a B chain having a sequence of amino acids set forth in SEQ ID NO:147 or 149.

58. The combination of claim 53, wherein the hyaluronan degrading enzyme is a hyaluronidase.

59. The combination of claim 58, wherein the hyaluronidase is a soluble hyaluronidase.

60. The combination of claim 59, wherein the soluble hyaluronidase is a PH20, or a truncated form thereof that lacks all or a portion of a glycosylphosphatidylinositol (GPI) anchor.

61. The combination of claim 60, wherein the PH20 is selected from an ovine, bovine or truncated human PH20.

62. The combination of claim 61, wherein the truncated human PH20 is selected from among polypeptides having a sequence of amino acids set forth in any of SEQ ID NOS:4-9, and variants thereof that have 60%, 70%, 80%, 90%, 91%, 92%, 93%, 94%, 95%, 96%, 97%, 98%, or 99% sequence identity to a polypeptide set forth in any of SEQ ID NOS: 4-9, and that exhibit hyaluronidase activity.

63. The combination of claim 53, wherein the hyaluronidase is a soluble hyaluronidase provided as a composition designated rHuPH20.

64. The combination of claim 53, wherein the hyaluronan degrading enzyme is a chondroitinase.

65. The combination of claim 64, wherein the chondroitinase is selected from among the group consisting of chondroitin ABC lyase, chondroitin AC lyase and chondroitin C lyase.

66. The combination of claim 65, wherein the precursor chondroitinase or chondroitinase has a sequence of amino acids set forth in any of SEQ ID NOS:98-100, truncated forms thereof and variants thereof that have 60%, 70%, 80%, 90%, 91%, 92%, 93%, 94%, 95%, 96%, 97%, 98%, or 99% sequence identity to a polypeptide set forth in any of SEQ ID NOS: 98-100, and that have the ability to degrade hyaluronan.

67. A kit comprising the combination of claim 53, and optionally instructions.

68. The composition of claim 1, wherein the amount of hyaluronan degrading enzyme to insulin analog in the composition is 1 hyaluronidase U/insulin analog U (1:1) to 50:1, or is 1:1, 2:1, 3:1, 4:1, 5:1, 6:1, 7:1, 8:1, 9:1, 10:1, 11:1, 12:1, 13:1, 14:1, 15:1, 20:1, 25:1, 30:1, 35:1, 40:1, 45:1 or 50:1.

69. The composition of claim 1, wherein:
the composition has a pH between or about between 6.5 to 7.5; and
the composition comprises:
a stabilizer for the fast-acting insulin analog or hyaluronan degrading enzyme or both; and
a preservative.

70. The composition of claim 69, wherein the stabilizer is selected from among a detergent, a polyalcohol, a metal, a salt a cosolvent and/or a protein.

71. The composition of claim 70, wherein:
the composition comprises a salt that is NaCl in an amount between or about between 50 mM to 200 mM; and
the composition comprises a detergent that is a surfactant in an amount between or about between 0.001% to 0.1%.

72. The composition of claim 71, wherein the surfactant is a polysorbate or is poloxamer 188.

73. The composition of claim 69, wherein the preservative contains an aromatic ring.

74. The composition of claim 73, wherein the preservative is m-cresol or phenol.

75. The composition of claim 74, wherein the amount of m-cresol is 0.05% to 0.2% and the amount of phenol is 0.05% to 0.25%.

76. The composition of claim 69, further comprising an oxygen scavenger.

77. The composition of claim 76, wherein the oxygen scavenger is selected from among ascorbic acid, ascorbate, citric acid, citrate, methionine and albumin.

78. The composition of claim 77, comprising methionine at a concentration of or about 1 mM, 2 mM, 3 mM, 5 mM, 10 mM, or 20 mM.

79. The composition of claim 69, wherein the composition comprises a pH buffer to maintain the pH, wherein the buffer is selected from among histidine, phosphate and Tris.

80. The composition of claim 1, wherein the kinetics of the onset of action of a super fast-acting insulin composition, upon administration, mimics the physiologic post-prandial insulin response in non-diabetic individuals.

81. The composition of claim 1, wherein the onset of action and duration of action mimics physiologic insulin release in a subject to maintain glucose concentrations between 70-130 mg/dL.

* * * * *

UNITED STATES PATENT AND TRADEMARK OFFICE
CERTIFICATE OF CORRECTION

PATENT NO.         : 8,318,154 B2                                Page 1 of 2
APPLICATION NO.    : 12/387225
DATED              : November 27, 2012
INVENTOR(S)        : Gregory I. Frost et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 241 days.

At column 82, line 37, please replace "WO199929230" with --WO199929230)--.

Column 165, lines 15 to 36 should read
1. A super fast-acting insulin composition, comprising:
a therapeutically effective amount of a fast-acting insulin analog for controlling blood
    glucose levels, wherein the fast-acting analog is insulin aspart or insulin glulisine;
    and
an amount of a hyaluronan degrading enzyme sufficient to render the composition a
    super fast-acting insulin composition, wherein:
the sufficient amount of a hyaluronan degrading enzyme to render the composition a
    super fast-acting insulin composition is 1 Unit or more hyaluronidase activity/mL;
the super fast-acting insulin composition has an onset of action that is faster than the
    analog alone, and a duration of action that is shorter than the analog alone, whereby,
    upon administration, the composition closely mimics the physiologic post-prandial
    insulin response of a non-diabetic subject to achieve glycemic control; and
the super fast-acting insulin composition is formulated for a route of administration
    selected from among subcutaneous, intradermal, intramuscular and intraperitoneal
    administration.

Column 167, line 63 to column 168, line 18 should read
37.  A closed loop system for controlling blood glucose levels in a subject, comprising:
a fast-acting insulin analog selected from insulin aspart or insulin glulisine; and Signed and Sealed this
Second Day of April, 2013

Teresa Stanek Rea
*Acting Director of the United States Patent and Trademark Office* a hyaluronan degrading enzyme, wherein:
- the fast-acting insulin analog and the hyaluronan degrading enzyme are in the same or different reservoirs;
- the amount of a hyaluronan degrading enzyme is sufficient, when combined with the insulin, to render the insulin a super fast-acting insulin;

the concentration of hyaluronan degrading enzyme in the closed loop system is 1 Unit or more hyaluronidase activity/mL; and the fast-acting insulin analog and the hyaluronan degrading enzyme, when combined, form a super fast-acting insulin, which has an onset of action that is faster than the analog alone, and a duration of action that is shorter than the analog alone, whereby, upon administration, the insulin closely mimics the physiologic post-prandial insulin response of a non-diabetic subject to achieve glycemic control.

Column 169, lines 1 to 7 should read
50. The closed loop system of claim 37, wherein the system is capable of delivering the fast-acting insulin analog in individual dose increments of from at or about 0.1 Units, 0.2 Units, 0.3 Units, 0.4 Units, 0.5 Units, 0.6 Units, 0.7 Units, 0.8 Units, 0.9 Units, 1 Unit, 2 Units, 5 Units, 10 Units, 15 Units, 20 Units, 25 Units, 30 Units, 35 Units, 40 Units, 50 Units or more of fast-acting insulin analog.

Column 169, lines 1 to 7 should read
53. A combination, comprising:
a first composition containing from or from about 10 Units (U) to or to about 500 U of a fast-acting insulin analog selected from insulin aspart or insulin glulisine; and
a second composition containing a sufficient amount of a hyaluronan degrading enzyme that, when administered with the insulin, renders the composition containing the fast-acting insulin analog a super fast-acting insulin composition; wherein:
- the sufficient amount of hyaluronan degrading enzyme is functionally equivalent to at least or about 1 U hyaluronidase activity/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL, 25 U/mL, 30 U/mL, 35 U/mL, 37.5 U/mL, 40 U/mL, 50 U/mL, 60 U/mL, 70 U/mL, 80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/mL, 2000 U/mL, 3000 U/mL or 5000 U/mL; and
- the fast-acting insulin analog and the hyaluronan degrading enzyme, when combined, form a super fast-acting insulin, which has an onset of action that is faster than the analog alone, and a duration of action that is shorter than the analog alone, whereby, upon administration, the insulin closely mimics the physiologic post-prandial insulin response of a non-diabetic subject to achieve glycemic control.

UNITED STATES PATENT AND TRADEMARK OFFICE
CERTIFICATE OF CORRECTION

PATENT NO. : 8,318,154 B2
APPLICATION NO. : 12/387225
DATED : November 27, 2012
INVENTOR(S) : Gregory I. Frost et al.

Page 1 of 3

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 241 days.

In the Specification

At column 82, line 37, please replace "WO 199929230" with --WO 199929230)--.

Column 165, lines 15 to 36 should read
1.    A super fast-acting insulin composition, comprising:
a therapeutically effective amount of a fast-acting insulin analog for controlling blood
    glucose levels, wherein the fast-acting analog is insulin aspart or insulin glulisine;
    and
an amount of a hyaluronan degrading enzyme sufficient to render the composition a
    super fast-acting insulin composition, wherein:
the sufficient amount of a hyaluronan degrading enzyme to render the composition a
    super fast-acting insulin composition is 1 Unit or more hyaluronidase activity/mL;
the super fast-acting insulin composition has an onset of action that is faster than the
    analog alone, and a duration of action that is shorter than the analog alone, whereby,
    upon administration, the composition closely mimics the physiologic post-prandial
    insulin response of a non-diabetic subject to achieve glycemic control; and
the super fast-acting insulin composition is formulated for a route of administration
    selected from among subcutaneous, intradermal, intramuscular and intraperitoneal
    administration.

This certificate supersedes the Certificate of Correction issued April 2, 2013.

Signed and Sealed this
Twenty-ninth Day of October, 2013

Teresa Stanek Rea
*Deputy Director of the United States Patent and Trademark Office*

CERTIFICATE OF CORRECTION (continued)
U.S. Pat. No. 8,318,154 B2

Column 167, lines 9 to 13 should read
21. The composition of claim 1, wherein the insulin analog is selected from among an insulin having an A chain with a sequence of amino acids set forth in SEQ NO:103 and a B chain having a sequence of amino acids set forth in SEQ ID NO: 147 or 149.

Column 167, line 63 to column 168, line 18 should read
37. A closed loop system for controlling blood glucose levels in a subject, comprising:
a fast-acting insulin analog selected from insulin aspart or insulin glulisine; and
a hyaluronan degrading enzyme, wherein:
    the fast-acting insulin analog and the hyaluronan degrading enzyme are in the same or different reservoirs;
    the amount of a hyaluronan degrading enzyme is sufficient, when combined with the insulin, to render the insulin a super fast-acting insulin;
the concentration of hyaluronan degrading enzyme in the closed loop system is 1 Unit or more hyaluronidase activity/mL; and
the fast-acting insulin analog and the hyaluronan degrading enzyme, when combined, form a super fast-acting insulin, which has an onset of action that is faster than the analog alone, and a duration of action that is shorter than the analog alone, whereby, upon administration, the insulin closely mimics the physiologic post-prandial insulin response of a non-diabetic subject to achieve glycemic control.

Column 169, lines 1 to 7 should read
50. The closed loop system of claim 37, wherein the system is capable of delivering the fast-acting insulin analog in individual dose increments of from at or about 0.1 Units, 0.2 Units, 0.3 Units, 0.4 Units, 0.5 Units, 0.6 Units, 0.7 Units, 0.8 Units, 0.9 Units, 1 Unit, 2 Units, 5 Units, 10 Units, 15 Units, 20 Units, 25 Units, 30 Units, 35 Units, 40 Units, 50 Units or more of fast-acting insulin analog.

Column 169, lines 27 to 53 should read
53. A combination, comprising:
a first composition containing from or from about 10 Units (U) to or to about 500 U of a fast-acting insulin analog selected from insulin aspart or insulin glulisine; and
a second composition containing a sufficient amount of a hyaluronan degrading enzyme that, when administered with the insulin, renders the composition containing the fast-acting insulin analog a super fast-acting insulin composition; wherein:
    the sufficient amount of hyaluronan degrading enzyme is functionally equivalent to at least or about 1 U hyaluronidase activity/mL, 2 U/mL, 3 U/mL, 4 U/mL, 5 U/mL, 6 U/mL, 7 U/mL, 8 U/mL, 9 U/mL, 10 U/mL, 15 U/mL, 20 U/mL, 25 U/mL, 30 U/mL, 35 U/mL, 37.5 U/mL, 40 U/mL, 50 U/mL, 60 U/mL, 70 U/mL, 80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/mL, 2000 U/mL, 3000 U/mL or 5000 U/mL; and

CERTIFICATE OF CORRECTION (continued)
U.S. Pat. No. 8,318,154 B2

> the fast-acting insulin analog and the hyaluronan degrading enzyme, when combined, form a super fast-acting insulin, which has an onset of action that is faster than the analog alone, and a duration of action that is shorter than the analog alone, whereby, upon administration, the insulin closely mimics the physiologic post-prandial insulin response of a non-diabetic subject to achieve glycemic control.

Column 169, line 66 to column 170, line 3 should read

57. The combination of claim 53, wherein the insulin analog is selected from among an insulin having an A chain with a sequence of amino acids set forth in SEQ NO:103 and a B chain having a sequence of amino acids set forth in SEQ ID NO: 147 or 149.

UNITED STATES PATENT AND TRADEMARK OFFICE
CERTIFICATE OF CORRECTION

| | | |
|---|---|---|
| PATENT NO. | : 8,318,154 B2 | Page 1 of 2 |
| APPLICATION NO. | : 12/387225 | |
| DATED | : November 27, 2012 | |
| INVENTOR(S) | : Gregory I. Frost et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 454 days.

In the Specifications:

At column 82, line 37, please replace "WO199929230" with --WO199929230)--.

In the Claims:

Column 165, lines 15 to 36 should read
1. A super fast-acting insulin composition, comprising:
a therapeutically effective amount of a fast-acting insulin analog for controlling blood
    glucose levels, wherein the fast-acting analog is insulin aspart or insulin glulisine;
    and
an amount of a hyaluronan degrading enzyme sufficient to render the composition a
    super fast-acting insulin composition, wherein:
the sufficient amount of a hyaluronan degrading enzyme to render the composition a
    super fast-acting insulin composition is 1 Unit or more hyaluronidase activity/mL;
the super fast-acting insulin composition has an onset of action that is faster than the
    analog alone, and a duration of action that is shorter than the analog alone, whereby,
    upon administration, the composition closely mimics the physiologic post-prandial
    insulin response of a non-diabetic subject to achieve glycemic control; and
the super fast-acting insulin composition is formulated for a route of administration
    selected from among subcutaneous, intradermal, intramuscular and intraperitoneal
    administration.

This certificate supersedes the Certificate of Correction issued April 2, 2013.

Signed and Sealed this
Twenty-fourth Day of December, 2013

Margaret A. Focarino
*Commissioner for Patents of the United States Patent and Trademark Office*

CERTIFICATE OF CORRECTION (continued)

U.S. Pat. No. 8,318,154 B2

Column 167, line 63 to column 168, line 18 should read

37. A closed loop system for controlling blood glucose levels in a subject, comprising:
a fast-acting insulin analog selected from insulin aspart or insulin glulisine; and
a hyaluronan degrading enzyme, wherein:
    the fast-acting insulin analog and the hyaluronan degrading enzyme are in the same
        or different reservoirs;
    the amount of a hyaluronan degrading enzyme is sufficient, when combined with
        the insulin, to render the insulin a super fast-acting insulin;
the concentration of hyaluronan degrading enzyme in the closed loop system is 1
    Unit or more hyaluronidase activity/mL; and
the fast-acting insulin analog and the hyaluronan degrading enzyme, when
    combined, form a super fast-acting insulin, which has an onset of action that is
    faster than the analog alone, and a duration of action that is shorter than the
    analog alone, whereby, upon administration, the insulin closely mimics the
    physiologic post-prandial insulin response of a non-diabetic subject to achieve
    glycemic control.

Column 169, lines 1 to 7 should read

50. The closed loop system of claim 37, wherein the system is capable of delivering
the fast-acting insulin analog in individual dose increments of from at or about 0.1 Units,
0.2 Units, 0.3 Units, 0.4 Units, 0.5 Units, 0.6 Units, 0.7 Units, 0.8 Units, 0.9 Units, 1
Unit, 2 Units, 5 Units, 10 Units, 15 Units, 20 Units, 25 Units, 30 Units, 35 Units, 40
Units, 50 Units or more of fast-acting insulin analog.

Column 169, lines 27 to 53 should read

53. A combination, comprising:
a first composition containing from or from about 10 Units (U) to or to about 500 U of a
    fast-acting insulin analog selected from insulin aspart or insulin glulisine; and
a second composition containing a sufficient amount of a hyaluronan degrading enzyme
    that, when administered with the insulin, renders the composition containing the fast-acting
    insulin analog a super fast-acting insulin composition; wherein:
    the sufficient amount of hyaluronan degrading enzyme is functionally equivalent to
        at least or about 1 U hyaluronidase activity/mL, 2 U/mL, 3 U/mL, 4 U/mL, 5
        U/mL, 6 U/mL, 7 U/mL, 8 U/mL, 9 U/mL, 10 U/mL, 15 U/mL, 20 U/mL, 25
        U/mL, 30 U/mL, 35 U/mL, 37.5 U/mL, 40 U/mL, 50 U/mL, 60 U/mL, 70 U/mL,
        80 U/mL, 90 U/mL, 100 U/mL, 200 U/mL, 300 U/mL, 400 U/mL, 500 U/mL,
        600 U/mL, 700 U/mL, 800 U/mL, 900 U/mL, 1000 U/mL, 2000 U/mL, 3000
        U/mL or 5000 U/mL; and
    the fast-acting insulin analog and the hyaluronan degrading enzyme, when
        combined, form a super fast-acting insulin, which has an onset of action that is
        faster than the analog alone, and a duration of action that is shorter than the
        analog alone, whereby, upon administration, the insulin closely mimics the
        physiologic post-prandial insulin response of a non-diabetic subject to achieve
        glycemic control.

UNITED STATES PATENT AND TRADEMARK OFFICE
CERTIFICATE OF CORRECTION

Page 1 of 3

PATENT NO. : 8,318,154 B2
APPLICATION NO. : 12/387225
DATED : November 27, 2012
INVENTOR(S) : Gregory I. Frost et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 454 days.

In the Specification:

At column 82, line 37, please replace "WO 199929230" with --WO 199929230)--.

In the Claims

Column 165, lines 15 to 36 should read
1. A super fast-acting insulin composition, comprising:
a therapeutically effective amount of a fast-acting insulin analog for controlling blood
glucose levels, wherein the fast-acting analog is insulin aspart or insulin glulisine;
and
an amount of a hyaluronan degrading enzyme sufficient to render the composition a
super fast-acting insulin composition, wherein:
the sufficient amount of a hyaluronan degrading enzyme to render the composition a
super fast-acting insulin composition is 1 Unit or more hyaluronidase activity/mL;
the super fast-acting insulin composition has an onset of action that is faster than the
analog alone, and a duration of action that is shorter than the analog alone, whereby,
upon administration, the composition closely mimics the physiologic post-prandial
insulin response of a non-diabetic subject to achieve glycemic control; and This certificate supersedes the Certificates of Correction issued April 2, 2013, October 29, 2013, and December 24, 2013.

Signed and Sealed this
Twenty-eighth Day of January, 2014

Michelle K. Lee
*Deputy Director of the United States Patent and Trademark Office*

CERTIFICATE OF CORRECTION (continued)
U.S. Pat. No. 8,318,154 B2 the super fast-acting insulin composition is formulated for a route of administration
    selected from among subcutaneous, intradermal, intramuscular and intraperitoneal
    administration.

Column 167, lines 9 to 13 should read
21.     The composition of claim 1, wherein the insulin analog is selected from among
an insulin having an A chain with a sequence of amino acids set forth in SEQ NO: 103
and a B chain having a sequence of amino acids set forth in SEQ ID NO: 147 or 149.

Column 167, line 63 to column 168, line 18 should read
37.     A closed loop system for controlling blood glucose levels in a subject, comprising:
a fast-acting insulin analog selected from insulin aspart or insulin glulisine; and
a hyaluronan degrading enzyme, wherein:
    the fast-acting insulin analog and the hyaluronan degrading enzyme are in the same
        or different reservoirs;
    the amount of a hyaluronan degrading enzyme is sufficient, when combined with
        the insulin, to render the insulin a super fast-acting insulin;
the concentration of hyaluronan degrading enzyme in the closed loop system is 1
    Unit or more hyaluronidase activity/mL; and
the fast-acting insulin analog and the hyaluronan degrading enzyme, when
    combined, form a super fast-acting insulin, which has an onset of action that is
    faster than the analog alone, and a duration of action that is shorter than the
    analog alone, whereby, upon administration, the insulin closely mimics the
    physiologic post-prandial insulin response of a non-diabetic subject to achieve
    glycemic control.

Column 169, lines 1 to 7 should read
50.     The closed loop system of claim 37, wherein the system is capable of delivering
the fast-acting insulin analog in individual dose increments of from at or about 0.1 Units,
0.2 Units, 0.3 Units, 0.4 Units, 0.5 Units, 0.6 Units, 0.7 Units, 0.8 Units, 0.9 Units, 1
Unit, 2 Units, 5 Units, 10 Units, 15 Units, 20 Units, 25 Units, 30 Units, 35 Units, 40
Units, 50 Units or more of fast-acting insulin analog.

Column 169, lines 27 to 53 should read
53.     A combination, comprising:
a first composition containing from or from about 10 Units (U) to or to about 500 U of a
    fast-acting insulin analog selected from insulin aspart or insulin glulisine; and
a second composition containing a sufficient amount of a hyaluronan degrading enzyme
    that, when administered with the insulin, renders the composition containing the fast-acting
    insulin analog a super fast-acting insulin composition; wherein:
    the sufficient amount of hyaluronan degrading enzyme is functionally equivalent to
        at least or about 1 U hyaluronidase activity/mL, 2 U/mL, 3 U/mL, 4 U/mL, 5
        U/mL, 6 U/mL, 7 U/mL, 8 U/mL, 9 U/mL, 10 U/mL, 15 U/mL, 20 U/mL, 25
        U/mL, 30 U/mL, 35 U/mL, 37.5 U/mL, 40 U/mL, 50 U/mL, 60 U/mL, 70 U/mL,
        80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/mL, 2000 U/mL, 3000 U/mL or 5000 U/mL; and the fast-acting insulin analog and the hyaluronan degrading enzyme, when combined, form a super fast-acting insulin, which has an onset of action that is faster than the analog alone, and a duration of action that is shorter than the analog alone, whereby, upon administration, the insulin closely mimics the physiologic post-prandial insulin response of a non-diabetic subject to achieve glycemic control.

Column 169, line 66 to column 170, line 3 should read

57. The combination of claim 53, wherein the insulin analog is selected from among an insulin having an A chain with a sequence of amino acids set forth in SEQ NO: 103 and a B chain having a sequence of amino acids set forth in SEQ ID NO: 147 or 149.

UNITED STATES PATENT AND TRADEMARK OFFICE
CERTIFICATE OF CORRECTION

| | | |
|---|---|---|
| PATENT NO. | : 8,318,154 B2 | Page 1 of 3 |
| APPLICATION NO. | : 12/387225 | |
| DATED | : November 27, 2012 | |
| INVENTOR(S) | : Gregory I. Frost et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 454 days.

In the Specification:

At column 82, line 37, please replace "WO 199929230" with --WO 199929230)--.

In the Claims:

Column 165, lines 15 to 36 should read
1. A super fast-acting insulin composition, comprising:
a therapeutically effective amount of a fast-acting insulin analog for controlling blood
    glucose levels, wherein the fast-acting analog is insulin aspart or insulin glulisine;
    and
an amount of a hyaluronan degrading enzyme sufficient to render the composition a
    super fast-acting insulin composition, wherein:
the sufficient amount of a hyaluronan degrading enzyme to render the composition a
    super fast-acting insulin composition is 1 Unit or more hyaluronidase activity/mL;
the super fast-acting insulin composition has an onset of action that is faster than the
    analog alone, and a duration of action that is shorter than the analog alone, whereby,
    upon administration, the composition closely mimics the physiologic post-prandial
    insulin response of a non-diabetic subject to achieve glycemic control; and This certificate supersedes all previously issued Certificates of Correction.

<div style="text-align: right;">
Signed and Sealed this<br>
Thirteenth Day of May, 2014
</div>

<div style="text-align: right;">
Michelle K. Lee<br>
<i>Deputy Director of the United States Patent and Trademark Office</i>
</div>

CERTIFICATE OF CORRECTION (continued)
U.S. Pat. No. 8,318,154 B2 the super fast-acting insulin composition is formulated for a route of administration
    selected from among subcutaneous, intradermal, intramuscular and intraperitoneal
    administration.

Column 167, lines 9 to 13 should read
21.    The composition of claim 1, wherein the insulin analog is selected from among
an insulin having an A chain with a sequence of amino acids set forth in SEQ NO: 103
and a B chain having a sequence of amino acids set forth in SEQ ID NO: 147 or 149.

Column 167, line 63 to column 168, line 18 should read
37.    A closed loop system for controlling blood glucose levels in a subject, comprising:
a fast-acting insulin analog selected from insulin aspart or insulin glulisine; and
a hyaluronan degrading enzyme, wherein:
    the fast-acting insulin analog and the hyaluronan degrading enzyme are in the same
        or different reservoirs;
    the amount of a hyaluronan degrading enzyme is sufficient, when combined with
        the insulin, to render the insulin a super fast-acting insulin;
the concentration of hyaluronan degrading enzyme in the closed loop system is 1
    Unit or more hyaluronidase activity/mL; and
the fast-acting insulin analog and the hyaluronan degrading enzyme, when
    combined, form a super fast-acting insulin, which has an onset of action that is
    faster than the analog alone, and a duration of action that is shorter than the
    analog alone, whereby, upon administration, the insulin closely mimics the
    physiologic post-prandial insulin response of a non-diabetic subject to achieve
    glycemic control.

Column 169, lines 1 to 7 should read
50.    The closed loop system of claim 37, wherein the system is capable of delivering
the fast-acting insulin analog in individual dose increments of from at or about 0.1 Units, 0.2 Units,
0.3 Units, 0.4 Units, 0.5 Units, 0.6 Units, 0.7 Units, 0.8 Units, 0.9 Units, 1 Unit,
2 Units, 5 Units, 10 Units, 15 Units, 20 Units, 25 Units, 30 Units, 35 Units, 40 Units,
50 Units or more of fast-acting insulin analog.

Column 169, lines 27 to 53 should read
53.    A combination, comprising:
a first composition containing from or from about 10 Units (U) to or to about 500 U of a
    fast-acting insulin analog selected from insulin aspart or insulin glulisine; and
a second composition containing a sufficient amount of a hyaluronan degrading enzyme
    that, when administered with the insulin analog renders the composition containing the
    fast-acting insulin analog a super fast-acting insulin composition; wherein:
    the sufficient amount of hyaluronan degrading enzyme is functionally equivalent to
        at least or about 1 U hyaluronidase activity/mL, 2 U/mL, 3 U/mL, 4 U/mL,
        5 U/mL, 6 U/mL, 7 U/mL, 8 U/mL, 9 U/mL, 10 U/mL, 15 U/mL, 20 U/mL,
        25 U/mL, 30 U/mL, 35 U/mL, 37.5 U/mL, 40 U/mL, 50 U/mL, 60 U/mL, 70 U/mL,
        80 U/mL, 90 U/mL, 100 U/mL, 200 U/mL, 300 U/mL, 400 U/mL, 500 U/mL, 600 U/mL, 700 U/mL, 800 U/mL, 900 U/mL, 1000 U/mL, 2000 U/mL, 3000 U/mL or 5000 U/mL; and the fast-acting insulin analog and the hyaluronan degrading enzyme, when combined, form a super fast-acting insulin, which has an onset of action that is faster than the analog alone, and a duration of action that is shorter than the analog alone, whereby, upon administration, the insulin closely mimics the physiologic post-prandial insulin response of a non-diabetic subject to achieve glycemic control.

Column 169, line 66 to column 170, line 3 should read

57. The combination of claim 53, wherein the insulin analog is selected from among an insulin having an A chain with a sequence of amino acids set forth in SEQ NO: 103 and a B chain having a sequence of amino acids set forth in SEQ ID NO: 147 or 149.